United States Patent
Hamel et al.

(10) Patent No.: US 7,262,024 B2
(45) Date of Patent: Aug. 28, 2007

(54) STREPTOCOCCUS ANTIGENS

(75) Inventors: Josée Hamel, Sillery (CA); Nathalie Charland, Breakeyville (CA); Bernard R. Brodeur, Sillery (CA); Denis Martin, St-Augustin-de-Desmaures (CA); Normand Blais, Ste-Foy (CA); Catherine Ouellet, St-Jean Chrisostome (CA); Steve Labbe, Ile d'Orléans (CA)

(73) Assignee: ID Biomedical Corporation, Laval, Quebec (CA)

( * ) Notice: Subject to any disclaimer, the term of this patent is extended or adjusted under 35 U.S.C. 154(b) by 463 days.

(21) Appl. No.: 10/324,143

(22) Filed: Dec. 20, 2002

(65) Prior Publication Data

US 2003/0232976 A1    Dec. 18, 2003

Related U.S. Application Data

(60) Provisional application No. 60/341,252, filed on Dec. 20, 2001.

(51) Int. Cl.
*C12P 21/06* (2006.01)

(52) U.S. Cl. ............... 435/69.1; 435/320.1; 435/252.3; 435/69.3; 435/71.1; 435/243; 536/23.1; 536/23.7; 536/24.1; 536/24.2

(58) Field of Classification Search ............... 536/23.1, 536/23.7, 24.1, 242; 435/320.1, 69.1, 252.3, 435/69.3, 71.1, 243
See application file for complete search history.

(56) References Cited

U.S. PATENT DOCUMENTS

| | | | |
|---|---|---|---|
| 6,582,706 B1 | 6/2003 | Johnson et al. | |
| 6,699,703 B1 * | 3/2004 | Doucette-Stamm et al. | 435/252.3 |
| 6,800,744 B1 * | 10/2004 | Doucette-Stamm et al. | 536/23.1 |
| 2003/0077293 A1 | 4/2003 | Hamel et al. | |
| 2004/0081662 A1 | 4/2004 | Hermand et al. | |

FOREIGN PATENT DOCUMENTS

| WO | WO98/18930 | 5/1998 |
|---|---|---|
| WO | WO98/18931 | 5/1998 |
| WO | WO99/15675 | 4/1999 |
| WO | WO 00/06737 | 2/2000 |
| WO | WO 00/06738 | 2/2000 |
| WO | WO 00/17370 | 3/2000 |
| WO | WO 00/37105 | 6/2000 |
| WO | WO00/37105 | 6/2000 |
| WO | WO 00/39299 | 7/2000 |
| WO | WO 00/76540 A2 | 12/2000 |
| WO | WO 01/14421 A1 | 3/2001 |
| WO | WO01/98334 | 12/2001 |
| WO | WO02/077021 | 10/2002 |
| WO | WO2004/092209 | 10/2004 |

OTHER PUBLICATIONS

Mikayama et al. (Nov. 1993. Proc.Natl.Acad.Sci. USA, vol. 90 : 10056-10060).*
Rudinger et al. (Jun. 1976. Peptide Hormones. Biol.Council. pp. 5-7).*
Hamel et al (WO 20039229 corresponding to Gencore Accession No. AAA65737).*
Adamou et al (Infect. Immun. Feb. 2001, 69(2): 949-958).*
Milenen Hernandez et al., "Antigenicity of Chimeric Synthetic Peptides Based on HTLV-1 Antigens and the Impact of Eptiope Orientation." Biochemical and Biophysical Research Communication. vol. 276. No. 3, pp. 1085-1088.
Charalambos Partidos et al., "The Influence of orientation and number of copies of T and B cell epitopes on the specificity and affinity of antibodies Induced by chimeric peptides." Molecular Immunology Unit, Department of Clinical Sciences, London School of Hygiene and Tropical Medicine, London. Eur. J. Immunol 1992, 22: pp. 2675-2680.
Oishi Y. et al., "The effect of the amino acid spacers on the antigenicity of dimeric peptide-inducing cross reacting antibodies to a cell surface protein antigen of Streptococcus mutans." Oral Microbiol Immunol 2001: 16: pp. 40-44.
Kurstak Edward, "Editorial Recent progress in vaccines development and new trends in immunization." Vaccine 19 (2001) pp. 2198-2200.
Briles D.E. et al, Immunization of Humans with Recombinant Pneumococcal Surface Protein A (rPsspA) Elicits Antibodies that Passively Protect Mice from Fatal Infection with *Streptococcus pneumoniae* bearing Heterologous PspA J Infectious Disease 182 (Dec. 2000) 1694-1701.
Briles, D.E. et al, Intranasal Immunization of Mice with a Mixture of the Pneumococcal Proteins PsaA and PspA is Highly Protective against Nasopharyngeal Carriage of *Streptococcus pneumoniae* Infection & Immunity vol. 68 No. 2 (Feb. 2000) p. 796-800.
Gregor Z. et al, Detection of 23 Immuogenic Pneumococcal Proteins Using Convalescent-Phase Serum Infection & Immunity vol. 68 No. 6 (Jun. 2000) p. 3740-43 (exact publication date not available).
"Comparison of D1 (Seq ID Nos. 56 and 66) with BVH-11 Seq ID Nos. 7 and 8 of the present invention".
Boslego et al. "*Vaccines And Immuntherapy*" Pergamon Press, 1991, Chapter 17, pp. 211-223.
Ellis, et al. "*New Technologies for Making Vaccines*," WB Sanders Co., 1988, Chapter 29, pp. 568-575.
Spellerberg, et al., "Lmb, a Protein with Similarities to the Lral Adhesin Family, Mediates Attachment of *Streptococcus agalactiae* to Human Laminin", Infection and Immunity, Feb. 1999, p. 871-878.
Adamou, et al., "Identification and Characterization of a Novel Family of Pneumococcal Proteins That Are Protective Against Sepsis", Infection and Immunity, Feb. 2001, p. 949-958.
Wizemann, et al., "Use of a Whole Genome Approach to Identify Vaccine Molecules Affording Protection Against *Streptococcus pneumoniae* Infection", Infection and Immunity, Mar. 2001, p. 1593-1598.

(Continued)

*Primary Examiner*—Jennifer Graser
(74) *Attorney, Agent, or Firm*—Seed IP Law Group PLLC

(57) ABSTRACT

The present invention relates to polypeptides of *Streptococcus pneumoniae* which may be used for prophylaxis, diagnostic and/or therapy purposes.

12 Claims, 22 Drawing Sheets

OTHER PUBLICATIONS

Zhang, et al., "Recombinant PhpA Protein, a Unique Histidine Motif-Containing Protein from *Streptococcus pneumoniae*, Protects Mice against Intranasal Pneumococcal Challenge", Infection and Immunity, Jun. 2001, p. 3827-3836.

U.S. Appl. No. 09/471,255, filed Dec. 23, 1999, Hamel et al.

Orihuela, et al., "Organ-specific models of *Streptococcus pneumoniae* Disease," Scandinavian Journal of Infectious Diseases, vol. 35, No. 9, 2003, p. 647-652.

Whittam, et al. "Inference from whole-genome sequences of bacterial pathogens," Current Opinion in Genetics and Development, Dec. 2002, vol. 12, No. 6, pp. 719-725.

Sa-Leao, et al., Abstracts of the General Meeting of the American Society for Microbiology, May 20-24, 2001.

Creighton, Thomas E., in his book, "Proteins: Structures and Molecular Principles," 1984, pp. 314-315.

Creighton, Thomas E., in his book "Protein Structure: A Practical Approach," 1989: pp. 184-186.

Nosoh, et al. in "Protein Stability and Stabilization through Protein Engineering," 1991, pp. 197-217.

Oli, et al., "Redirecting the Humoral Immune Response against Streptococcus mutans Antigen P1 with Monoclonal Antibodies," Infection and Immunity, Dec. 2004, p. 6951-6960.

Swildens, et al., "Intestinal translocation of Streptococcus suis type 2 EF$^+$ in pigs," Veterinary Microbiology 103, 2004, pp. 29-33.

Bolton, et al., "Use of the surface proteins GapC and Mig of *Streptococcus dysgalactiae* as potential protective antigens against bovine mastitis," Can J. Microbiol., Jun. 2004, 50(6):423-32 (Abstract only).

Okamoto, et al., "Vaccination with formalin-inactivated influenza vaccine protects mice against lethal influenza Streptococcus pyogenes superinfection," Vaccine 22 (2004, pp. 2887-2893.

* cited by examiner

MQITYTDDEIQVAKLAGKYTTEDGYIFDTSWIKKDSLSEAERAAAQAYAKEKGLTPPSTDHQDSGNTEAK
GAEAIYNRVKAAKKVPLDRMPYNLQYTVEVKNGSLIIPHHDHYHNIKFEWFDEGLYEAPKGYSLEDLLAT
VKYYVEPRNASDHVRKNKADQDSKPDEDKEHDEVSEPTHPESDEKENHAGLNPSADNLYKPSTDTEETEE
EAEDTTDEAEIPGTPSIRQNAMETLTGLKSSLLLGTKDNNTISAEVDSLLALLKESQPAPIQ
(SEQ ID No1)

FIG. 1

MQITYTDDEIQVAKLAGKYTTEDGYIFDGGWIKKDSLSEAERAAAQAYAKEKGLTPPSTDHQDSGNTEAK
GAEAIYNRVKAAKKVPLDRMPYNLQYTVEVKNGSLIIPHHDHYHNIKFEWFDEGLYEAPKGYSLEDLLAT
VKYYVEGGNASDHVRKNKADQDSKPDEDKEHDEVSEPTHPESDEKENHAGLNPSADNLYKPSTDTEETEE
EAEDTTDEAEIPGGPSIRQNAMETLTGLKSSLLLGTKDNNTISAEVDSLLALLKESQPAPIQ
(SEQ ID No2)

FIG. 2

MQITYTDDEIQVAKLAGKYTTEDGYIFDGGWIKKDSLSEAERAAAQAYAKEKGLTPPSTDHQDSGNTEAK
GAEAIYNRVKAAKKVPLDRMPYNLQYTVEVKNGSLIIPHHDHYHNIKFEWFDEGLYEAPKGYSLEDLLAT
VKYYVEGGNASDHVRKNKADQDSKPDEDKEHDEVSEPTHPESDEKENHAGLNPSADNLYKPSTDTEETEE
EAEDTTDEAEIPGGPSIRQNAMETLTGLKSSLLLGTKDNNTISAEVDSLLALLKESQPAPIQGGQIGQPT
LPNNSLATPSPSLPINPGTSHEKHEEDGYGFDANRIIAEDESGFVMSHGDSNHYFFKKDLTEEQIKAAQK
HLEEVKTSHNGLDSLSSHEQDYPGNAKEMKDLDKKIEEKIAGIMKQYGVKRESIVVNKEKNAIIYPSGDH
HHADPIDEHKPVGIGHSHSNYELFKPEEGVAKKEGNKVYTGEELTNVVNLLKNSTFNNQNFTLANGQKRV
SFSFPPELEKKLGINMLVKLITPDGKVLEKVSGKVFGEGVGNIANFELDQPYLPGQTFKYTIASKDYPEV
SYDGTFTVPTSLAYKMASQTIFYPFHAGDTYLRVNPQFAVPKGTDALVRVFDEFHGNAYLENNYKVGEIK
LPIPKLNQGTTRTAGNKIPVTFMANAYLDNQSTYIVEVPILEKENQTDKPSILPQFKRNKAQENSKLDEK
VEEPKTSEKVEKEKLSETGNSTSNSTLEEVPTVDPVQEKVAKFAESYGMKLENVLFNMDGTIELYLPSGE
VIKKNMADFTGEAPQGNGENKPSENGKVSTGTVENQPTENKPADSLPEAPNEKPVKPENSTDNGMLNPEG
NVGSDPMLDPALEEAPAVDPVQEKLEKFTASYGLGLDSVIFNMDGTIELRLPSGEVIKKNLSDFIA*
(SEQ ID No3)

FIG. 3

| | |
|---|---|
| 1 | ATGCAAATTA CCTACACTGA TGATGAGATT CAGGTAGCCA AGTTGGCAGG |
| 51 | CAAGTACACA ACAGAAGACG GTTATATCTT TGATACTAGT TGGATTAAAA |
| 101 | AAGATAGTTT GTCTGAAGCT GAGAGAGCGG CAGCCCAGGC TTATGCTAAA |
| 151 | GAGAAAGGTT TGACCCCTCC TTCGACAGAC CACCAGGATT CAGGAAATAC |
| 201 | TGAGGCAAAA GGAGCAGAAG CTATCTACAA CCGCGTGAAA GCAGCTAAGA |
| 251 | AGGTGCCACT TGATCGTATG CCTTACAATC TTCAGTATAC TGTAGAAGTC |
| 301 | AAAAACGGTA GTTAATCAT ACCTCATCAT GACCATTACC ATAACATCAA |
| 351 | ATTTGAGTGG TTTGACGAAG GCCTTTATGA GGCACCTAAG GGGTATAGTC |
| 401 | TTGAGGATCT TTTGGCGACT GTCAAGTACT ATGTCGAACC GCGGAACGCT |
| 451 | AGTGACCATG TTCGTAAAAA TAAGGCAGAC CAAGATAGTA AACCTGATGA |
| 501 | AGATAAGGAA CATGATGAAG TAAGTGAGCC AACTCACCCT GAATCTGATG |
| 551 | AAAAAGAGAA TCACGCTGGT TTAAATCCTT CAGCAGATAA TCTTTATAAA |
| 601 | CCAAGCACTG ATACGGAAGA GACAGAGGAA GAAGCTGAAG ATACCACAGA |
| 651 | TGAGGCTGAA ATTCCTGGTA CCCCTAGTAT TAGACAAAAT GCTATGGAGA |
| 701 | CATTGACTGG TCTAAAAAGT AGTCTTCTTC TCGGAACGAA AGATAATAAC |
| 751 | ACTATTTCAG CAGAAGTAGA TAGTCTCTTG GCTTTGTTAA AGAAAGTCA |
| 801 | ACCGGCTCCT ATACAG |

(SEQ ID No4)

FIG. 4

| | |
|---|---|
| 1 | ATGCAAATTA CCTACACTGA TGATGAGATT CAGGTAGCCA AGTTGGCAGG |
| 51 | CAAGTACACA ACAGAAGACG GTTATATCTT TGATACTAGT TGGATTAAAA |
| 101 | AAGATAGTTT GTCTGAAGCT GAGAGAGCGG CAGCCCAGGC TTATGCTAAA |
| 151 | GAGAAAGGTT TGACCCCTCC TTCGACAGAC CACCAGGATT CAGGAAATAC |
| 201 | TGAGGCAAAA GGAGCAGAAG CTATCTACAA CCGCGTGAAA GCAGCTAAGA |
| 251 | AGGTGCCACT TGATCGTATG CCTTACAATC TTCAGTATAC TGTAGAAGTC |
| 301 | AAAAACGGTA GTTAATCAT ACCTCATCAT GACCATTACC ATAACATCAA |
| 351 | ATTTGAGTGG TTTGACGAAG GCCTTTATGA GGCACCTAAG GGGTATAGTC |
| 401 | TTGAGGATCT TTTGGCGACT GTCAAGTACT ATGTCGAACC GCGGAACGCT |
| 451 | AGTGACCATG TTCGTAAAAA TAAGGCAGAC CAAGATAGTA AACCTGATGA |
| 501 | AGATAAGGAA CATGATGAAG TAAGTGAGCC AACTCACCCT GAATCTGATG |
| 551 | AAAAAGAGAA TCACGCTGGT TTAAATCCTT CAGCAGATAA TCTTTATAAA |
| 601 | CCAAGCACTG ATACGGAAGA GACAGAGGAA GAAGCTGAAG ATACCACAGA |
| 651 | TGAGGCTGAA ATTCCTGGTA CCCCTAGTAT TAGACAAAAT GCTATGGAGA |
| 701 | CATTGACTGG TCTAAAAAGT AGTCTTCTTC TCGGAACGAA AGATAATAAC |
| 751 | ACTATTTCAG CAGAAGTAGA TAGTCTCTTG GCTTTGTTAA AGAAAGTCA |
| 801 | ACCGGCTCCT ATACAG |

(SEQ ID No5)

```
                       1                                                          60
      VP147     (1)    MQITYTDDEIQVAKLAGKYTTEDGYIFDGGWIKKDSLSEAERAAAQAYAKEKGLTPPSTD
      VP147-R1  (1)    MQITYTDDEIQVAKLAGKYTTEDGYIFDGGWIKKDSLSEAERAAAQAYAKEKGLTPPSTD
      VP147-R2  (1)    MQITYTDDEIQVAKLAGKYTTEDGYIFDGGWIKKDSLSEAERAAAQAYAKEKGLTPPSTD
      VP147-R3  (1)    MQITYTDDEIQVAKLAGKYTTEDGYIFDGGWIKKDSLSEAERAAAQAYAKEKGLTPPSTD
      VP147-L1  (1)    MQITYTDDEIQVAKLAGKYTTEDGYIFDGGWIKKDSLSEAERAAAQAYAKEKGLTPPSTD
      VP147-L2  (1)    MQITYTDDEIQVAKLAGKYTTEDGYIFDGGWIKKDSLSEAERAAAQAYAKEKGLTPPSTD
      VP147-L3  (1)    MQITYTDDEIQVAKLAGKYTTEDGYIFDGGWIKKDSLSEAERAAAQAYAKEKGLTPPSTD
      VP147-L4  (1)    MQITYTDDEIQVAKLAGKYTTEDGYIFDGGWIKKDSLSEAERAAAQAYAKEKGLTPPSTD
   VP147-R2-L4  (1)    MQITYTDDEIQVAKLAGKYTTEDGYIFDGGWIKKDSLSEAERAAAQAYAKEKGLTPPSTD
     Consensus  (1)    MQITYTDDEIQVAKLAGKYTTEDGYIFDGGWIKKDSLSEAERAAAQAYAKEKGLTPPSTD
                       61                                                         120
      VP147    (61)    HQDSGNTEAKGAEAIYNRVKAAKKVPLDRMPYNLQYTVEVKNGSLIIPHHDHYHNIKFEW
      VP147-R1 (61)    HQDSGNTEAKGAEAIYNRVKAAKKVPLDRMPYNLQYTVEVKNGSLIIPHHDHYHNIKFEW
      VP147-R2 (61)    HQDSGNTEAKGAEAIYNRVKAAKKVPLDRMPYNLQYTVEVKNGSLIIPHHDHYHNIKFEW
      VP147-R3 (61)    HQDSGNTEAKGAEAIYNRVKAAKKVPLDRMPYNLQYTVEVKNGSLIIPHHDHYHNIKFEW
      VP147-L1 (61)    HQDSGNTEAKGAEAIYNRVKAAKKVPLDRMPYNLQYTVEVKNGSLIIPHHDHYHNIKFEW
      VP147-L2 (61)    HQDSGNTEAKGAEAIYNRVKAAKKVPLDRMPYNLQYTVEVKNGSLIIPHHDHYHNIKFEW
      VP147-L3 (61)    HQDSGNTEAKGAEAIYNRVKAAKKVPLDRMPYNLQYTVEVKNGSLIIPHHDHYHNIKFEW
      VP147-L4 (61)    HQDSGNTEAKGAEAIYNRVKAAKKVPLDRMPYNLQYTVEVKNGSLIIPHHDHYHNIKFEW
   VP147-R2-L4 (61)    HQDSGNTEAKGAEAIYNRVKAAKKVPLDRMPYNLQYTVEVKNGSLIIPHHDHYHNIKFEW
     Consensus (61)    HQDSGNTEAKGAEAIYNRVKAAKKVPLDRMPYNLQYTVEVKNGSLIIPHHDHYHNIKFEW
                       121                                                        180
      VP147   (121)    FDEGLYEAPKGYSLEDLLATVKYYVEGGNASDHVRKNKADQDSKPDEDKEHDEVSEPTHP
      VP147-R1(121)    FDEGLYEAPKGYSLEDLLATVKYYVEGGNASDHVRKNKADQDSKPDEDKEHDEVSEPTHP
      VP147-R2(121)    FDEGLYEAPKGYSLEDLLATVKYYVEGGNASDHVRKNKADQDSKPDEDKEHDEVSEPTHP
      VP147-R3(121)    FDEGLYEAPKGYSLEDLLATVKYYVEGGNASDHVRKNKADQDSKPDEDKEHDEVSEPTHP
      VP147-L1(121)    FDEGLYEAPKGYSLEDLLATVKYYVEGGNASDHVRKNKADQDSKPDEDKEHDEVSEPTHP
      VP147-L2(121)    FDEGLYEAPKGYSLEDLLATVKYYVEGGNASDHVRKNKADQDSKPDEDKEHDEVSEPTHP
      VP147-L3(121)    FDEGLYEAPKGYSLEDLLATVKYYVEGGNASDHVRKNKADQDSKPDEDKEHDEVSEPTHP
      VP147-L4(121)    FDEGLYEAPKGYSLEDLLATVKYYVEGGNASDHVRKNKADQDSKPDEDKEHDEVSEPTHP
   VP147-R2-L4(121)    FDEGLYEAPKGYSLEDLLATVKYYVEGGNASDHVRKNKADQDSKPDEDKEHDEVSEPTHP
     Consensus(121)    FDEGLYEAPKGYSLEDLLATVKYYVEGGNASDHVRKNKADQDSKPDEDKEHDEVSEPTHP
                       181                                                        240
      VP147   (181)    ESDEKENHAGLNPSADNLYKPSTDTEETEEEAEDTTDEAEIPG-----------------
      VP147-R1(181)    ESDEKENHAGLNPSADNLYKPSTDTEETEEEAEDTTDEAEIPSILPQFKRNKAQENSKLD
      VP147-R2(181)    ESDEKENHAGLNPSADNLYKPSTDTEETEEEAEDTTDEAEIPQFKKDLTEEQIKAAQKHL
      VP147-R3(181)    ESDEKENHAGLNPSADNLYKPSTDTEETEEEAEDTTDEAEIP----QFKRNKAQENSKLD
      VP147-L1(181)    ESDEKENHAGLNPSADNLYKPSTDTEETEEEAEDTTDEAEIPG-----------------
      VP147-L2(181)    ESDEKENHAGLNPSADNLYKPSTDTEETEEEAEDTTDEAEIPG-----------------
      VP147-L3(181)    ESDEKENHAGLNPSADNLYKPSTDTEETEEEAEDTTDEAEIPG-----------------
      VP147-L4(181)    ESDEKENHAGLNPSADNLYKPSTDTEETEEEAEDTTDEAEIPGG----------------
   VP147-R2-L4(181)    ESDEKENHAGLNPSADNLYKPSTDTEETEEEAEDTTDEAEIPQFKKDLTEEQIKAAQKHL
     Consensus(181)    ESDEKENHAGLNPSADNLYKPSTDTEETEEEAEDTTDEAEIPG
                       241                                                        300
      VP147   (224)    ----GPSIRQNAMETLTGLKSSLLLGTKDNNTISAEVDSLLALLKESQPAPIQG------
      VP147-R1(241)    EKVEEPSIRQNAMETLTGLKSSLLLGTKDNNTISAEVDSLLALLKESQPAPIQG------
      VP147-R2(241)    EEVKTPSIRQNAMETLTGLKSSLLLGTKDNNTISAEVDSLLALLKESQPAPIQ-------
      VP147-R3(237)    EKVEEPSIRQNAMETLTGLKSSLLLGTKDNNTISAEVDSLLALLKESQPAPIQG------
      VP147-L1(224)    ----GPSIRQNAMETLTGLKSSLLLGTKDNNTISAEVDSLLALLKESQPAPIQGDAAAKE
      VP147-L2(224)    ----GPSIRQNAMETLTGLKSSLLLGTKDNNTISAEVDSLLALLKESQPAPIQGNAKEMK
      VP147-L3(224)    ----GPSIRQNAMETLTGLKSSLLLGTKDNNTISAEVDSLLALLKESQPAPIQG------
      VP147-L4(225)    -----PSIRQNAMETLTGLKSSLLLGTKDNNTISAEVDSLLALLKESQPAPIQS------
   VP147-R2-L4(241)    EEVKTPSIRQNAMETLTGLKSSLLLGTKDNNTISAEVDSLLALLKESQPAPIQS------
     Consensus(241)         PSIRQNAMETLTGLKSSLLLGTKDNNTISAEVDSLLALLKESQPAPIQG
```

*FIG. 8A*

```
                      301                                                        360
      VP147   (274)  ------------------GQIGQPTLPNNSLATPSPSLPINPGTSHEKHEEDGYGFDANR
   VP147-R1   (295)  ------------------GQIGQPTLPNNSLATPSPSLPINPGTSHEKHEEDGYGFDANR
   VP147-R2   (294)  -----------------GGQIGQPTLPNNSLATPSPSLPINPGTSHEKHEEDGYGFDANR
   VP147-R3   (291)  ------------------GQIGQPTLPNNSLATPSPSLPINPGTSHEKHEEDGYGFDANR
   VP147-L1   (280)  AAAKEAAAKEAAAKEAAAKQIGQPTLPNNSLATPSPSLPINPGTSHEKHEEDGYGFDANR
   VP147-L2   (280)  EADKKAQEKIAEA-MKQYGQIGQPTLPNNSLATPSPSLPINPGTSHEKHEEDGYGFDANR
   VP147-L3   (274)  -----STNQYG---NQTSGQIGQPTLPNNSLATPSPSLPINPGTSHEKHEEDGYGFDANR
   VP147-L4   (274)  ---------ETGNSTSNSTQIGQPTLPNNSLATPSPSLPINPGTSHEKHEEDGYGFDANR
VP147-R2-L4   (295)  ---------ETGNSTSNSTQIGQPTLPNNSLATPSPSLPINPGTSHEKHEEDGYGFDANR
  Consensus   (301)                    GQIGQPTLPNNSLATPSPSLPINPGTSHEKHEEDGYGFDANR
                      361                                                        420
      VP147   (316)  IIAEDESGFVMSHGDSNHYFFKKDLTEEQIKAAQKHLEEVKTSHNGLDSLSSHEQDYPGN
   VP147-R1   (337)  IIAEDESGFVMSHGDSNHYFFKKDLTEEQIKAAQKHLEEVKTSHNGLDSLSSHEQDYPGN
   VP147-R2   (337)  IIAEDESGFVMSHGDSNHYFFKKDLTEEQIKAAQKHLEEVKTSHNGLDSLSSHEQDYPGN
   VP147-R3   (333)  IIAEDESGFVMSHGDSNHYFFKKDLTEEQIKAAQKHLEEVKTSHNGLDSLSSHEQDYPGN
   VP147-L1   (340)  IIAEDESGFVMSHGDSNHYFFKKDLTEEQIKAAQKHLEEVKTSHNGLDSLSSHEQDYPGN
   VP147-L2   (339)  IIAEDESGFVMSHGDSNHYFFKKDLTEEQIKAAQKHLEEVKTSHNGLDSLSSHEQDYPGN
   VP147-L3   (326)  IIAEDESGFVMSHGDSNHYFFKKDLTEEQIKAAQKHLEEVKTSHNGLDSLSSHEQDYPGN
   VP147-L4   (325)  IIAEDESGFVMSHGDSNHYFFKKDLTEEQIKAAQKHLEEVKTSHNGLDSLSSHEQDYPGN
VP147-R2-L4   (346)  IIAEDESGFVMSHGDSNHYFFKKDLTEEQIKAAQKHLEEVKTSHNGLDSLSSHEQDYPGN
  Consensus   (361)  IIAEDESGFVMSHGDSNHYFFKKDLTEEQIKAAQKHLEEVKTSHNGLDSLSSHEQDYPGN
                      421                                                        480
      VP147   (376)  AKEMKDLDKKIEEKIAGIMKQYGVKRESIVVNKEKNAIIYPSGDHHHADPIDEHKPVGIG
   VP147-R1   (397)  AKEMKDLDKKIEEKIAGIMKQYGVKRESIVVNKEKNAIIYPSGDHHHADPIDEHKPVGIG
   VP147-R2   (397)  AKEMKDLDKKIEEKIAGIMKQYGVKRESIVVNKEKNAIIYPSGDHHHADPIDEHKPVGIG
   VP147-R3   (393)  AKEMKDLDKKIEEKIAGIMKQYGVKRESIVVNKEKNAIIYPSGDHHHADPIDEHKPVGIG
   VP147-L1   (400)  AKEMKDLDKKIEEKIAGIMKQYGVKRESIVVNKEKNAIIYPSGDHHHADPIDEHKPVGIG
   VP147-L2   (399)  AKEMKDLDKKIEEKIAGIMKQYGVKRESIVVNKEKNAIIYPSGDHHHADPIDEHKPVGIG
   VP147-L3   (386)  AKEMKDLDKKIEEKIAGIMKQYGVKRESIVVNKEKNAIIYPSGDHHHADPIDEHKPVGIG
   VP147-L4   (385)  AKEMKDLDKKIEEKIAGIMKQYGVKRESIVVNKEKNAIIYPSGDHHHADPIDEHKPVGIG
VP147-R2-L4   (406)  AKEMKDLDKKIEEKIAGIMKQYGVKRESIVVNKEKNAIIYPSGDHHHADPIDEHKPVGIG
  Consensus   (421)  AKEMKDLDKKIEEKIAGIMKQYGVKRESIVVNKEKNAIIYPSGDHHHADPIDEHKPVGIG
                      481                                                        540
      VP147   (436)  HSHSNYELFKPEEGVAKKEGNKVYTGEELTNVVNLLKNSTFNNQNFTLANGQKRVSFSFP
   VP147-R1   (457)  HSHSNYELFKPEEGVAKKEGNKVYTGEELTNVVNLLKNSTFNNQNFTLANGQKRVSFSFP
   VP147-R2   (457)  HSHSNYELFKPEEGVAKKEGNKVYTGEELTNVVNLLKNSTFNNQNFTLANGQKRVSFSFP
   VP147-R3   (453)  HSHSNYELFKPEEGVAKKEGNKVYTGEELTNVVNLLKNSTFNNQNFTLANGQKRVSFSFP
   VP147-L1   (460)  HSHSNYELFKPEEGVAKKEGNKVYTGEELTNVVNLLKNSTFNNQNFTLANGQKRVSFSFP
   VP147-L2   (459)  HSHSNYELFKPEEGVAKKEGNKVYTGEELTNVVNLLKNSTFNNQNFTLANGQKRVSFSFP
   VP147-L3   (446)  HSHSNYELFKPEEGVAKKEGNKVYTGEELTNVVNLLKNSTFNNQNFTLANGQKRVSFSFP
   VP147-L4   (445)  HSHSNYELFKPEEGVAKKEGNKVYTGEELTNVVNLLKNSTFNNQNFTLANGQKRVSFSFP
VP147-R2-L4   (466)  HSHSNYELFKPEEGVAKKEGNKVYTGEELTNVVNLLKNSTFNNQNFTLANGQKRVSFSFP
  Consensus   (481)  HSHSNYELFKPEEGVAKKEGNKVYTGEELTNVVNLLKNSTFNNQNFTLANGQKRVSFSFP
                      541                                                        600
      VP147   (496)  PELEKKLGINMLVKLITPDGKVLEKVSGKVFGEGVGNIANFELDQPYLPGQTFKYTIASK
   VP147-R1   (517)  PELEKKLGINMLVKLITPDGKVLEKVSGKVFGEGVGNIANFELDQPYLPGQTFKYTIASK
   VP147-R2   (517)  PELEKKLGINMLVKLITPDGKVLEKVSGKVFGEGVGNIANFELDQPYLPGQTFKYTIASK
   VP147-R3   (513)  PELEKKLGINMLVKLITPDGKVLEKVSGKVFGEGVGNIANFELDQPYLPGQTFKYTIASK
   VP147-L1   (520)  PELEKKLGINMLVKLITPDGKVLEKVSGKVFGEGVGNIANFELDQPYLPGQTFKYTIASK
   VP147-L2   (519)  PELEKKLGINMLVKLITPDGKVLEKVSGKVFGEGVGNIANFELDQPYLPGQTFKYTIASK
   VP147-L3   (506)  PELEKKLGINMLVKLITPDGKVLEKVSGKVFGEGVGNIANFELDQPYLPGQTFKYTIASK
   VP147-L4   (505)  PELEKKLGINMLVKLITPDGKVLEKVSGKVFGEGVGNIANFELDQPYLPGQTFKYTIASK
VP147-R2-L4   (526)  PELEKKLGINMLVKLITPDGKVLEKVSGKVFGEGVGNIANFELDQPYLPGQTFKYTIASK
  Consensus   (541)  PELEKKLGINMLVKLITPDGKVLEKVSGKVFGEGVGNIANFELDQPYLPGQTFKYTIASK
```

*FIG. 8B*

```
                    601                                                        660
VP147       (556)  DYPEVSYDGTFTVPTSLAYKMASQTIFYPFHAGDTYLRVNPQFAVPKGTDALVRVFDEFH
VP147-R1    (577)  DYPEVSYDGTFTVPTSLAYKMASQTIFYPFHAGDTYLRVNPQFAVPKGTDALVRVFDEFH
VP147-R2    (577)  DYPEVSYDGTFTVPTSLAYKMASQTIFYPFHAGDTYLRVNPQFAVPKGTDALVRVFDEFH
VP147-R3    (573)  DYPEVSYDGTFTVPTSLAYKMASQTIFYPFHAGDTYLRVNPQFAVPKGTDALVRVFDEFH
VP147-L1    (580)  DYPEVSYDGTFTVPTSLAYKMASQTIFYPFHAGDTYLRVNPQFAVPKGTDALVRVFDEFH
VP147-L2    (579)  DYPEVSYDGTFTVPTSLAYKMASQTIFYPFHAGDTYLRVNPQFAVPKGTDALVRVFDEFH
VP147-L3    (566)  DYPEVSYDGTFTVPTSLAYKMASQTIFYPFHAGDTYLRVNPQFAVPKGTDALVRVFDEFH
VP147-L4    (565)  DYPEVSYDGTFTVPTSLAYKMASQTIFYPFHAGDTYLRVNPQFAVPKGTDALVRVFDEFH
VP147-R2-L4 (586)  DYPEVSYDGTFTVPTSLAYKMASQTIFYPFHAGDTYLRVNPQFAVPKGTDALVRVFDEFH
Consensus   (601)  DYPEVSYDGTFTVPTSLAYKMASQTIFYPFHAGDTYLRVNPQFAVPKGTDALVRVFDEFH
                    661                                                        720
VP147       (616)  GNAYLENNYKVGEIKLPIPKLNQGTTRTAGNKIPVTFMANAYLDNQSTYIVEVPILEKEN
VP147-R1    (637)  GNAYLENNYKVGEIKLPIPKLNQGTTRTAGNKIPVTFMANAYLDNQSTYIVEVPILEKEN
VP147-R2    (637)  GNAYLENNYKVGEIKLPIPKLNQGTTRTAGNKIPVTFMANAYLDNQSTYIVEVPILEKEN
VP147-R3    (633)  GNAYLENNYKVGEIKLPIPKLNQGTTRTAGNKIPVTFMANAYLDNQSTYIVEVPILEKEN
VP147-L1    (640)  GNAYLENNYKVGEIKLPIPKLNQGTTRTAGNKIPVTFMANAYLDNQSTYIVEVPILEKEN
VP147-L2    (639)  GNAYLENNYKVGEIKLPIPKLNQGTTRTAGNKIPVTFMANAYLDNQSTYIVEVPILEKEN
VP147-L3    (626)  GNAYLENNYKVGEIKLPIPKLNQGTTRTAGNKIPVTFMANAYLDNQSTYIVEVPILEKEN
VP147-L4    (625)  GNAYLENNYKVGEIKLPIPKLNQGTTRTAGNKIPVTFMANAYLDNQSTYIVEVPILEKEN
VP147-R2-L4 (646)  GNAYLENNYKVGEIKLPIPKLNQGTTRTAGNKIPVTFMANAYLDNQSTYIVEVPILEKEN
Consensus   (661)  GNAYLENNYKVGEIKLPIPKLNQGTTRTAGNKIPVTFMANAYLDNQSTYIVEVPILEKEN
                    721                                                        780
VP147       (676)  QTDKPSILPQFKRNKAQENSKLDEKVEEPKTSEKVEKEKLSETGNSTSNSTLEEVPTVDP
VP147-R1    (697)  QTDKPSILPQFKRNKAQENSKLDEKVEEPKTSEKVEKEKLSETGNSTSNSTLEEVPTVDP
VP147-R2    (697)  QTDKPSILPQFKRNKAQENSKLDEKVEEPKTSEKVEKEKLSETGNSTSNSTLEEVPTVDP
VP147-R3    (693)  QTDKPSILPQFKRNKAQENSKLDEKVEEPKTSEKVEKEKLSETGNSTSNSTLEEVPTVDP
VP147-L1    (700)  QTDKPSILPQFKRNKAQENSKLDEKVEEPKTSEKVEKEKLSETGNSTSNSTLEEVPTVDP
VP147-L2    (699)  QTDKPSILPQFKRNKAQENSKLDEKVEEPKTSEKVEKEKLSETGNSTSNSTLEEVPTVDP
VP147-L3    (686)  QTDKPSILPQFKRNKAQENSKLDEKVEEPKTSEKVEKEKLSETGNSTSNSTLEEVPTVDP
VP147-L4    (685)  QTDKPSILPQFKRNKAQENSKLDEKVEEPKTSEKVEKEKLSETGNSTSNSTLEEVPTVDP
VP147-R2-L4 (706)  QTDKPSILPQFKRNKAQENSKLDEKVEEPKTSEKVEKEKLSETGNSTSNSTLEEVPTVDP
Consensus   (721)  QTDKPSILPQFKRNKAQENSKLDEKVEEPKTSEKVEKEKLSETGNSTSNSTLEEVPTVDP
                    781                                                        840
VP147       (736)  VQEKVAKFAESYGMKLENVLFNMDGTIELYLPSGEVIKKNMADFTGEAPQGNGENKPSEN
VP147-R1    (757)  VQEKVAKFAESYGMKLENVLFNMDGTIELYLPSGEVIKKNMADFTGEAPQGNGENKPSEN
VP147-R2    (757)  VQEKVAKFAESYGMKLENVLFNMDGTIELYLPSGEVIKKNMADFTGEAPQGNGENKPSEN
VP147-R3    (753)  VQEKVAKFAESYGMKLENVLFNMDGTIELYLPSGEVIKKNMADFTGEAPQGNGENKPSEN
VP147-L1    (760)  VQEKVAKFAESYGMKLENVLFNMDGTIELYLPSGEVIKKNMADFTGEAPQGNGENKPSEN
VP147-L2    (759)  VQEKVAKFAESYGMKLENVLFNMDGTIELYLPSGEVIKKNMADFTGEAPQGNGENKPSEN
VP147-L3    (746)  VQEKVAKFAESYGMKLENVLFNMDGTIELYLPSGEVIKKNMADFTGEAPQGNGENKPSEN
VP147-L4    (745)  VQEKVAKFAESYGMKLENVLFNMDGTIELYLPSGEVIKKNMADFTGEAPQGNGENKPSEN
VP147-R2-L4 (766)  VQEKVAKFAESYGMKLENVLFNMDGTIELYLPSGEVIKKNMADFTGEAPQGNGENKPSEN
Consensus   (781)  VQEKVAKFAESYGMKLENVLFNMDGTIELYLPSGEVIKKNMADFTGEAPQGNGENKPSEN
                    841                                                        900
VP147       (796)  GKVSTGTVENQPTENKPADSLPEAPNEKPVKPENSTDNGMLNPEGNVGSDPMLDPALEEA
VP147-R1    (817)  GKVSTGTVENQPTENKPADSLPEAPNEKPVKPENSTDNGMLNPEGNVGSDPMLDPALEEA
VP147-R2    (817)  GKVSTGTVENQPTENKPADSLPEAPNEKPVKPENSTDNGMLNPEGNVGSDPMLDPALEEA
VP147-R3    (813)  GKVSTGTVENQPTENKPADSLPEAPNEKPVKPENSTDNGMLNPEGNVGSDPMLDPALEEA
VP147-L1    (820)  GKVSTGTVENQPTENKPADSLPEAPNEKPVKPENSTDNGMLNPEGNVGSDPMLDPALEEA
VP147-L2    (819)  GKVSTGTVENQPTENKPADSLPEAPNEKPVKPENSTDNGMLNPEGNVGSDPMLDPALEEA
VP147-L3    (806)  GKVSTGTVENQPTENKPADSLPEAPNEKPVKPENSTDNGMLNPEGNVGSDPMLDPALEEA
VP147-L4    (805)  GKVSTGTVENQPTENKPADSLPEAPNEKPVKPENSTDNGMLNPEGNVGSDPMLDPALEEA
VP147-R2-L4 (826)  GKVSTGTVENQPTENKPADSLPEAPNEKPVKPENSTDNGMLNPEGNVGSDPMLDPALEEA
Consensus   (841)  GKVSTGTVENQPTENKPADSLPEAPNEKPVKPENSTDNGMLNPEGNVGSDPMLDPALEEA
```

*FIG. 8C*

|  |  | 901 | 953 |
|---|---|---|---|
| VP147 | (856) | PAVDPVQEKLEKFTASYGLGLDSVIFNMDGTIELRLPSGEVIKKNLSDFIAAA | |
| VP147-R1 | (877) | PAVDPVQEKLEKFTASYGLGLDSVIFNMDGTIELRLPSGEVIKKNLSDFIAAA | |
| VP147-R2 | (877) | PAVDPVQEKLEKFTASYGLGLDSVIFNMDGTIELRLPSGEVIKKNLSDFIAAA | |
| VP147-R3 | (873) | PAVDPVQEKLEKFTASYGLGLDSVIFNMDGTIELRLPSGEVIKKNLSDFIAAA | |
| VP147-L1 | (880) | PAVDPVQEKLEKFTASYGLGLDSVIFNMDGTIELRLPSGEVIKKNLSDFIAAA | |
| VP147-L2 | (879) | PAVDPVQEKLEKFTASYGLGLDSVIFNMDGTIELRLPSGEVIKKNLSDFIAAA | |
| VP147-L3 | (866) | PAVDPVQEKLEKFTASYGLGLDSVIFNMDGTIELRLPSGEVIKKNLSDFIAAA | |
| VP147-L4 | (865) | PAVDPVQEKLEKFTASYGLGLDSVIFNMDGTIELRLPSGEVIKKNLSDFIAAA | |
| VP147-R2-L4 | (886) | PAVDPVQEKLEKFTASYGLGLDSVIFNMDGTIELRLPSGEVIKKNLSDFIAAA | |
| Consensus | (901) | PAVDPVQEKLEKFTASYGLGLDSVIFNMDGTIELRLPSGEVIKKNLSDFIAAA | |

*FIG. 8D*

```
Met Lys Phe Ser Lys Lys Tyr Ile Ala Ala Gly Ser Ala Val Ile Val
 1               5                   10                  15
Ser Leu Ser Leu Cys Ala Tyr Ala Leu Asn Gln His Arg Ser Gln Glu
             20                  25                  30
Asn Lys Asp Asn Asn Arg Val Ser Tyr Val Asp Gly Ser Gln Ser Ser
             35                  40                  45
Gln Lys Ser Glu Asn Leu Thr Pro Asp Gln Val Ser Gln Lys Glu Gly
     50                  55                  60
Ile Gln Ala Glu Gln Ile Val Ile Lys Ile Thr Asp Gln Gly Tyr Val
65                   70                  75                  80
Thr Ser His Gly Asp His Tyr His Tyr Tyr Asn Gly Lys Val Pro Tyr
             85                  90                  95
Asp Ala Leu Phe Ser Glu Glu Leu Leu Met Lys Asp Pro Asn Tyr Gln
             100                 105                 110
Leu Lys Asp Ala Asp Ile Val Asn Glu Val Lys Gly Gly Tyr Ile Ile
             115                 120                 125
Lys Val Asp Gly Lys Tyr Tyr Val Tyr Leu Lys Asp Ala Ala His Ala
     130                 135                 140
Asp Asn Val Arg Thr Lys Asp Glu Ile Asn Arg Gln Lys Gln Glu His
145                 150                 155                 160
Val Lys Asp Asn Glu Lys Val Asn Ser Asn Val Ala Val Ala Arg Ser
             165                 170                 175
Gln Gly Arg Tyr Thr Thr Asn Asp Gly Tyr Val Phe Asn Pro Ala Asp
             180                 185                 190
Ile Ile Glu Asp Thr Gly Asn Ala Tyr Ile Val Pro His Gly Gly His
             195                 200                 205
Tyr His Tyr Ile Pro Lys Ser Asp Leu Ser Ala Ser Glu Leu Ala Ala
     210                 215                 220
Ala Lys Ala His Leu Ala Gly Lys Asn Met Gln Pro Ser Gln Leu Ser
225                 230                 235                 240
Tyr Ser Ser Thr Ala Ser Asp Asn Asn Thr Gln Ser Val Ala Lys Gly
             245                 250                 255
Ser Thr Ser Lys Pro Ala Asn Lys Ser Glu Asn Leu Gln Ser Leu Leu
             260                 265                 270
Lys Glu Leu Tyr Asp Ser Pro Ser Ala Gln Arg Tyr Ser Glu Ser Asp
             275                 280                 285
Gly Leu Val Phe Asp Pro Ala Lys Ile Ile Ser Arg Thr Pro Asn Gly
             290                 295                 300
Val Ala Ile Pro His Gly Asp His Tyr His Phe Ile Pro Tyr Ser Lys
305                 310                 315                 320
Leu Ser Ala Leu Glu Glu Lys Ile Ala Arg Met Val Pro Ile Ser Gly
             325                 330                 335
Thr Gly Ser Thr Val Ser Thr Asn Ala Lys Pro Asn Glu Val Val Ser
             340                 345                 350
Ser Leu Gly Ser Leu Ser Ser Asn Pro Ser Ser Leu Thr Thr Ser Lys
             355                 360                 365
Glu Leu Ser Ser Ala Ser Asp Gly Tyr Ile Phe Asn Pro Lys Asp Ile
```

*FIG. 9A*

```
           370                    375                    380
Val Glu Glu Thr Ala Thr Ala Tyr Ile Val Arg His Gly Asp His Phe
385                    390                    395                    400
His Tyr Ile Pro Lys Ser Asn Gln Ile Gly Gln Pro Thr Leu Pro Asn
                    405                    410                    415
Asn Ser Leu Ala Thr Pro Ser Pro Ser Leu Pro Ile Asn Pro Gly Thr
                    420                    425                    430
Ser His Glu Lys His Glu Glu Asp Gly Tyr Gly Phe Asp Ala Asn Arg
                    435                    440                    445
Ile Ile Ala Glu Asp Glu Ser Gly Phe Val Met Ser His Gly Asp His
                    450                    455                    460
Asn His Tyr Phe Phe Lys Lys Asp Leu Thr Glu Glu Gln Ile Lys Ala
465                    470                    475                    480
Ala Gln Lys His Leu Glu Glu Val Lys Thr Ser His Asn Gly Leu Asp
                    485                    490                    495
Ser Leu Ser Ser His Glu Gln Asp Tyr Pro Gly Asn Ala Lys Glu Met
                    500                    505                    510
Lys Asp Leu Asp Lys Lys Ile Glu Glu Lys Ile Ala Gly Ile Met Lys
                    515                    520                    525
Gln Tyr Gly Val Lys Arg Glu Ser Ile Val Val Asn Lys Glu Lys Asn
                    530                    535                    540
Ala Ile Ile Tyr Pro His Gly Asp His His His Ala Asp Pro Ile Asp
545                    550                    555                    560
Glu His Lys Pro Val Gly Ile Gly His Ser His Ser Asn Tyr Glu Leu
                    565                    570                    575
Phe Lys Pro Glu Glu Gly Val Ala Lys Lys Glu Gly Asn Lys Val Tyr
                    580                    585                    590
Thr Gly Glu Glu Leu Thr Asn Val Val Asn Leu Leu Lys Asn Ser Thr
                    595                    600                    605
Phe Asn Asn Gln Asn Phe Thr Leu Ala Asn Gly Gln Lys Arg Val Ser
                    610                    615                    620
Phe Ser Phe Pro Pro Glu Leu Glu Lys Lys Leu Gly Ile Asn Met Leu
625                    630                    635                    640
Val Lys Leu Ile Thr Pro Asp Gly Lys Val Leu Glu Lys Val Ser Gly
                    645                    650                    655
Lys Val Phe Gly Glu Gly Val Gly Asn Ile Ala Asn Phe Glu Leu Asp
                    660                    665                    670
Gln Pro Tyr Leu Pro Gly Gln Thr Phe Lys Tyr Thr Ile Ala Ser Lys
                    675                    680                    685
Asp Tyr Pro Glu Val Ser Tyr Asp Gly Thr Phe Thr Val Pro Thr Ser
                    690                    695                    700
Leu Ala Tyr Lys Met Ala Ser Gln Thr Ile Phe Tyr Pro Phe His Ala
705                    710                    715                    720
Gly Asp Thr Tyr Leu Arg Val Asn Pro Gln Phe Ala Val Pro Lys Gly
                    725                    730                    735
Thr Asp Ala Leu Val Arg Val Phe Asp Glu Phe His Gly Asn Ala Tyr
                    740                    745                    750
```

*FIG. 9B*

```
Leu Glu Asn Asn Tyr Lys Val Gly Glu Ile Lys Leu Pro Ile Pro Lys
        755                 760                 765
Leu Asn Gln Gly Thr Thr Arg Thr Ala Gly Asn Lys Ile Pro Val Thr
    770                 775                 780
Phe Met Ala Asn Ala Tyr Leu Asp Asn Gln Ser Thr Tyr Ile Val Glu
785                 790                 795                 800
Val Pro Ile Leu Glu Lys Glu Asn Gln Thr Asp Lys Pro Ser Ile Leu
            805                 810                 815
Pro Gln Phe Lys Arg Asn Lys Ala Gln Glu Asn Ser Lys Leu Asp Glu
            820                 825                 830
Lys Val Glu Glu Pro Lys Thr Ser Glu Lys Val Glu Lys Glu Lys Leu
        835                 840                 845
Ser Glu Thr Gly Asn Ser Thr Ser Asn Ser Thr Leu Glu Glu Val Pro
    850                 855                 860
Thr Val Asp Pro Val Gln Glu Lys Val Ala Lys Phe Ala Glu Ser Tyr
865                 870                 875                 880
Gly Met Lys Leu Glu Asn Val Leu Phe Asn Met Asp Gly Thr Ile Glu
            885                 890                 895
Leu Tyr Leu Pro Ser Gly Glu Val Ile Lys Lys Asn Met Ala Asp Phe
            900                 905                 910
Thr Gly Glu Ala Pro Gln Gly Asn Gly Glu Asn Lys Pro Ser Glu Asn
        915                 920                 925
Gly Lys Val Ser Thr Gly Thr Val Glu Asn Gln Pro Thr Glu Asn Lys
    930                 935                 940
Pro Ala Asp Ser Leu Pro Glu Ala Pro Asn Glu Lys Pro Val Lys Pro
945                 950                 955                 960
Glu Asn Ser Thr Asp Asn Gly Met Leu Asn Pro Glu Gly Asn Val Gly
            965                 970                 975
Ser Asp Pro Met Leu Asp Pro Ala Leu Glu Glu Ala Pro Ala Val Asp
            980                 985                 990
Pro Val Gln Glu Lys Leu Glu Lys Phe Thr Ala Ser Tyr Gly Leu Gly
        995                 1000                1005
Leu Asp Ser Val Ile Phe Asn Met Asp Gly Thr Ile Glu Leu Arg Leu
    1010                1015                1020
Pro Ser Gly Glu Val Ile Lys Lys Asn Leu Ser Asp Phe Ile Ala
1025                1030                1035
(SEQ ID No7)
```

*FIG. 9C*

```
Met Lys Ile Asn Lys Lys Tyr Leu Ala Gly Ser Val Ala Thr Leu Val
 1               5                  10                  15
Leu Ser Val Cys Ala Tyr Glu Leu Gly Leu His Gln Ala Gln Thr Val
             20                  25                  30
Lys Glu Asn Asn Arg Val Ser Tyr Ile Asp Gly Lys Gln Ala Thr Gln
         35                  40                  45
Lys Thr Glu Asn Leu Thr Pro Asp Glu Val Ser Lys Arg Glu Gly Ile
     50                  55                  60
Asn Ala Glu Gln Ile Val Ile Lys Ile Thr Asp Gln Gly Tyr Val Thr
 65                  70                  75                  80
Ser His Gly Asp His Tyr His Tyr Asn Gly Lys Val Pro Tyr Asp
                 85                  90                  95
Ala Ile Ile Ser Glu Glu Leu Leu Met Lys Asp Pro Asn Tyr Gln Leu
             100                 105                 110
Lys Asp Ser Asp Ile Val Asn Glu Ile Lys Gly Gly Tyr Val Ile Lys
         115                 120                 125
Val Asn Gly Lys Tyr Tyr Val Tyr Leu Lys Asp Ala Ala His Ala Asp
     130                 135                 140
Asn Val Arg Thr Lys Glu Glu Ile Asn Arg Gln Lys Gln Glu His Ser
145                 150                 155                 160
Gln His Arg Glu Gly Gly Thr Ser Ala Asn Asp Gly Ala Val Ala Phe
                 165                 170                 175
Ala Arg Ser Gln Gly Arg Tyr Thr Thr Asp Asp Gly Tyr Ile Phe Asn
             180                 185                 190
Ala Ser Asp Ile Ile Glu Asp Thr Gly Asp Ala Tyr Ile Val Pro His
         195                 200                 205
Gly Asp His Tyr His Tyr Ile Pro Lys Asn Glu Leu Ser Ala Ser Glu
     210                 215                 220
Leu Ala Ala Ala Glu Ala Phe Leu Ser Gly Arg Glu Asn Leu Ser Asn
225                 230                 235                 240
Leu Arg Thr Tyr Arg Arg Gln Asn Ser Asp Asn Thr Pro Arg Thr Asn
                 245                 250                 255
Trp Val Pro Ser Val Ser Asn Pro Gly Thr Thr Asn Thr Asn Thr Ser
             260                 265                 270
Asn Asn Ser Asn Thr Asn Ser Gln Ala Ser Gln Ser Asn Asp Ile Asp
         275                 280                 285
Ser Leu Leu Lys Gln Leu Tyr Lys Leu Pro Leu Ser Gln Arg His Val
     290                 295                 300
Glu Ser Asp Gly Leu Ile Phe Asp Pro Ala Gln Ile Thr Ser Arg Thr
305                 310                 315                 320
Ala Arg Gly Val Ala Val Pro His Gly Asn His Tyr His Phe Ile Pro
                 325                 330                 335
Tyr Glu Gln Met Ser Glu Leu Glu Lys Arg Ile Ala Arg Ile Ile Pro
             340                 345                 350
Leu Arg Tyr Arg Ser Asn His Trp Val Pro Asp Ser Arg Pro Glu Glu
         355                 360                 365
```

*FIG. 10A*

```
Pro Ser Pro Gln Pro Thr Pro Glu Pro Ser Pro Ser Pro Gln Pro Ala
    370             375             380
Pro Asn Pro Gln Pro Ala Pro Ser Asn Pro Ile Asp Glu Lys Leu Val
385             390             395                     400
Lys Glu Ala Val Arg Lys Val Gly Asp Gly Tyr Val Phe Glu Glu Asn
                405             410                 415
Gly Val Ser Arg Tyr Ile Pro Ala Lys Asn Leu Ser Ala Glu Thr Ala
            420             425             430
Ala Gly Ile Asp Ser Lys Leu Ala Lys Gln Glu Ser Leu Ser His Lys
            435             440             445
Leu Gly Ala Lys Lys Thr Asp Leu Pro Ser Ser Asp Arg Glu Phe Tyr
        450             455             460
Asn Lys Ala Tyr Asp Leu Leu Ala Arg Ile His Gln Asp Leu Leu Asp
465             470             475                     480
Asn Lys Gly Arg Gln Val Asp Phe Glu Ala Leu Asp Asn Leu Leu Glu
                485             490                 495
Arg Leu Lys Asp Val Ser Ser Asp Lys Val Lys Leu Val Asp Asp Ile
            500             505             510
Leu Ala Phe Leu Ala Pro Ile Arg His Pro Glu Arg Leu Gly Lys Pro
            515             520             525
Asn Ala Gln Ile Thr Tyr Thr Asp Asp Glu Ile Gln Val Ala Lys Leu
    530             535             540
Ala Gly Lys Tyr Thr Thr Glu Asp Gly Tyr Ile Phe Asp Pro Arg Asp
545             550             555                     560
Ile Thr Ser Asp Glu Gly Asp Ala Tyr Val Thr Pro His Met Thr His
                565             570                 575
Ser His Trp Ile Lys Lys Asp Ser Leu Ser Glu Ala Glu Arg Ala Ala
            580             585             590
Ala Gln Ala Tyr Ala Lys Glu Lys Gly Leu Thr Pro Pro Ser Thr Asp
            595             600             605
His Gln Asp Ser Gly Asn Thr Glu Ala Lys Gly Ala Glu Ala Ile Tyr
    610             615             620
Asn Arg Val Lys Ala Ala Lys Lys Val Pro Leu Asp Arg Met Pro Tyr
625             630             635                     640
Asn Leu Gln Tyr Thr Val Glu Val Lys Asn Gly Ser Leu Ile Ile Pro
                645             650                 655
His Tyr Asp His Tyr His Asn Ile Lys Phe Glu Trp Phe Asp Glu Gly
            660             665             670
Leu Tyr Glu Ala Pro Lys Gly Tyr Thr Leu Glu Asp Leu Leu Ala Thr
        675             680             685
Val Lys Tyr Tyr Val Glu His Pro Asn Glu Arg Pro His Ser Asp Asn
    690             695             700
Gly Phe Gly Asn Ala Ser Asp His Val Gln Arg Asn Lys Asn Gly Gln
705             710             715                     720
Ala Asp Thr Asn Gln Thr Glu Lys Pro Ser Glu Glu Lys Pro Gln Thr
                725             730                 735
```

*FIG. 10B*

```
Glu Lys Pro Glu Glu Glu Thr Pro Arg Glu Glu Lys Pro Gln Ser Glu
            740                 745                 750
Lys Pro Glu Ser Pro Lys Pro Thr Glu Glu Pro Glu Glu Glu Ser Pro
            755                 760                 765
Glu Glu Ser Glu Glu Pro Gln Val Glu Thr Glu Lys Val Glu Glu Lys
            770                 775                 780
Leu Arg Glu Ala Glu Asp Leu Leu Gly Lys Ile Gln Asp Pro Ile Ile
785                 790                 795                 800
Lys Ser Asn Ala Lys Glu Thr Leu Thr Gly Leu Lys Asn Asn Leu Leu
            805                 810                 815
Phe Gly Thr Gln Asp Asn Asn Thr Ile Met Ala Glu Ala Glu Lys Leu
            820                 825                 830
Leu Ala Leu Leu Lys Glu Ser Lys
            835                 840
(SEQ ID No8)
```

*FIG. 10C*

```
Met Lys Ile Asn Lys Lys Tyr Leu Ala Gly Ser Val Ala Val Leu Ala
 1               5                   10                  15
Leu Ser Val Cys Ser Tyr Glu Leu Gly Arg His Gln Ala Gly Gln Val
            20                  25                  30
Lys Lys Glu Ser Asn Arg Val Ser Tyr Ile Asp Gly Asp Gln Ala Gly
        35                  40                  45
Gln Lys Ala Glu Asn Leu Thr Pro Asp Glu Val Ser Lys Arg Glu Gly
    50                  55                  60
Ile Asn Ala Glu Gln Ile Val Ile Lys Ile Thr Asp Gln Gly Tyr Val
65                  70                  75                  80
Thr Ser His Gly Asp His Tyr His Tyr Tyr Asn Gly Lys Val Pro Tyr
                85                  90                  95
Asp Ala Ile Ile Ser Glu Glu Leu Leu Met Lys Asp Pro Asn Tyr Gln
            100                 105                 110
Leu Lys Asp Ser Asp Ile Val Asn Glu Ile Lys Gly Gly Tyr Val Ile
            115                 120                 125
Lys Val Asp Gly Lys Tyr Tyr Val Tyr Leu Lys Asp Ala Ala His Ala
    130                 135                 140
Asp Asn Ile Arg Thr Lys Glu Glu Ile Lys Arg Gln Lys Gln Glu His
145                 150                 155                 160
Ser His Asn His Asn Ser Arg Ala Asp Asn Ala Val Ala Ala Ala Arg
                165                 170                 175
Ala Gln Gly Arg Tyr Thr Thr Asp Asp Gly Tyr Ile Phe Asn Ala Ser
            180                 185                 190
Asp Ile Ile Glu Asp Thr Gly Asp Ala Tyr Ile Val Pro His Gly Asp
        195                 200                 205
His Tyr His Tyr Ile Pro Lys Asn Glu Leu Ser Ala Ser Glu Leu Ala
    210                 215                 220
Ala Ala Glu Ala Tyr Trp Asn Gly Lys Gln Gly Ser Arg Pro Ser Ser
225                 230                 235                 240
Ser Ser Ser Tyr Asn Ala Asn Pro Val Gln Pro Arg Leu Ser Glu Asn
            245                 250                 255
His Asn Leu Thr Val Thr Pro Thr Tyr His Gln Asn Gln Gly Glu Asn
            260                 265                 270
Ile Ser Ser Leu Leu Arg Glu Leu Tyr Ala Lys Pro Leu Ser Glu Arg
        275                 280                 285
His Val Glu Ser Asp Gly Leu Ile Phe Asp Pro Ala Gln Ile Thr Ser
    290                 295                 300
Arg Thr Ala Arg Gly Val Ala Val Pro His Gly Asn His Tyr His Phe
305                 310                 315                 320
Ile Pro Tyr Glu Gln Met Ser Glu Leu Glu Lys Arg Ile Ala Arg Ile
            325                 330                 335
Ile Pro Leu Arg Tyr Arg Ser Asn His Trp Val Pro Asp Ser Arg Pro
            340                 345                 350
Glu Gln Pro Ser Pro Gln Ser Thr Pro Glu Pro Ser Pro Ser Leu Gln
            355                 360                 365
```

*FIG. 11A*

```
Pro Ala Pro Asn Pro Gln Pro Ala Pro Ser Asn Pro Ile Asp Glu Lys
    370             375             380
Leu Val Lys Glu Ala Val Arg Lys Val Gly Asp Gly Tyr Val Phe Glu
385             390             395                             400
Glu Asn Gly Val Ser Arg Tyr Ile Pro Ala Lys Asp Leu Ser Ala Glu
                405             410             415
Thr Ala Ala Gly Ile Asp Ser Lys Leu Ala Lys Gln Glu Ser Leu Ser
            420             425             430
His Lys Leu Gly Ala Lys Lys Thr Asp Leu Pro Ser Ser Asp Arg Glu
        435             440             445
Phe Tyr Asn Lys Ala Tyr Asp Leu Leu Ala Arg Ile His Gln Asp Leu
    450             455             460
Leu Asp Asn Lys Gly Arg Gln Val Asp Phe Glu Val Leu Asp Asn Leu
465             470             475                             480
Leu Glu Arg Leu Lys Asp Val Ser Ser Asp Lys Val Lys Leu Val Asp
                485             490             495
Asp Ile Leu Ala Phe Leu Ala Pro Ile Arg His Pro Glu Arg Leu Gly
            500             505             510
Lys Pro Asn Ala Gln Ile Thr Tyr Thr Asp Asp Glu Ile Gln Val Ala
        515             520             525
Lys Leu Ala Gly Lys Tyr Thr Thr Glu Asp Gly Tyr Ile Phe Asp Pro
    530             535             540
Arg Asp Ile Thr Ser Asp Glu Gly Asp Ala Tyr Val Thr Pro His Met
545             550             555                             560
Thr His Ser His Trp Ile Lys Lys Asp Ser Leu Ser Glu Ala Glu Arg
                565             570             575
Ala Ala Ala Gln Ala Tyr Ala Lys Glu Lys Gly Leu Thr Pro Pro Ser
            580             585             590
Thr Asp His Gln Asp Ser Gly Asn Thr Glu Ala Lys Gly Ala Glu Ala
        595             600             605
Ile Tyr Asn Arg Val Lys Ala Ala Lys Lys Val Pro Leu Asp Arg Met
    610             615             620
Pro Tyr Asn Leu Gln Tyr Thr Val Glu Val Lys Asn Gly Ser Leu Ile
625             630             635                             640
Ile Pro His Tyr Asp His Tyr His Asn Ile Lys Phe Glu Trp Phe Asp
                645             650             655
Glu Gly Leu Tyr Glu Ala Pro Lys Gly Tyr Ser Leu Glu Asp Leu Leu
            660             665             670
Ala Thr Val Lys Tyr Tyr Val Glu His Pro Asn Glu Arg Pro His Ser
        675             680             685
Asp Asn Gly Phe Gly Asn Ala Ser Asp His Val Arg Lys Asn Lys Ala
    690             695             700
Asp Gln Asp Ser Lys Pro Asp Glu Asp Lys Glu His Asp Glu Val Ser
705             710             715                             720
Glu Pro Thr His Pro Glu Ser Asp Glu Lys Glu Asn His Ala Gly Leu
                725             730             735
```

*FIG. 11B*

```
Asn Pro Ser Ala Asp Asn Leu Tyr Lys Pro Ser Thr Asp Thr Glu Glu
            740                 745             750
Thr Glu Glu Glu Ala Glu Asp Thr Thr Asp Glu Ala Glu Ile Pro Gln
        755                 760             765
Val Glu Asn Ser Val Ile Asn Ala Lys Ile Ala Asp Ala Glu Ala Leu
        770                 775             780
Leu Glu Lys Val Thr Asp Pro Ser Ile Arg Gln Asn Ala Met Glu Thr
785                 790                 795                 800
Leu Thr Gly Leu Lys Ser Ser Leu Leu Leu Gly Thr Lys Asp Asn Asn
                805             810                 815
Thr Ile Ser Ala Glu Val Asp Ser Leu Leu Ala Leu Leu Lys Glu Ser
            820             825                 830
Gln Pro Ala Pro Ile Gln
        835
(SEQ ID No9)
```

*FIG. 11C*

```
atgcaaatta cctacactga tgatgagatt caggtagcca agttggcagg caagtacaca    60
acagaagacg gttatatctt tgatactagt tggattaaaa aagatagttt gtctgaagct   120
gagagagcgg cagcccaggc ttatgctaaa gagaaaggtt tgacccctcc ttcgacagac   180
caccaggatt caggaaatac tgaggcaaaa ggagcagaag ctatctacaa ccgcgtgaaa   240
gcagctaaga aggtgccact tgatcgtatg ccttacaatc ttcagtatac tgtagaagtc   300
aaaaacggta gtttaatcat acctcattat gaccattacc ataacatcaa atttgagtgg   360
tttgacgaag gcctttatga ggcacctaag gggtatagtc ttgaggatct tttggcgact   420
gtcaagtact atgtcgaacc gcggaacgct agtgaccatg ttcgtaaaaa taaggcagac   480
caagatagta aacctgatga agataaggaa catgatgaag taagtgagcc aactcaccct   540
gaatctgatg aaaaagagaa tcacgctggt ttaaatcctt cagcagataa tctttataaa   600
ccaagcactg atacggaaga gacagaggaa gaagctgaag ataccacaga tgaggctgaa   660
attcctggta cccctagtat tagacaaaat gctatggaga cattgactgg tctaaaaagt   720
agtcttcttc tcggaacgaa agataataac actatttcag cagaagtaga tagtctcttg   780
gctttgttaa aagaaagtca accggctcct atacagtag                          819
(SEQ ID No10)
```

FIG. 12

```
Met Gln Ile Thr Tyr Thr Asp Asp Glu Ile Gln Val Ala Lys Leu Ala
 1               5                  10                  15
Gly Lys Tyr Thr Thr Glu Asp Gly Tyr Ile Phe Asp Thr Ser Trp Ile
             20                  25                  30
Lys Lys Asp Ser Leu Ser Glu Ala Glu Arg Ala Ala Ala Gln Ala Tyr
             35                  40                  45
Ala Lys Glu Lys Gly Leu Thr Pro Pro Ser Thr Asp His Gln Asp Ser
     50                  55                  60
Gly Asn Thr Glu Ala Lys Gly Ala Glu Ala Ile Tyr Asn Arg Val Lys
 65                  70                  75                  80
Ala Ala Lys Lys Val Pro Leu Asp Arg Met Pro Tyr Asn Leu Gln Tyr
                 85                  90                  95
Thr Val Glu Val Lys Asn Gly Ser Leu Ile Ile Pro His Tyr Asp His
                100                 105                 110
Tyr His Asn Ile Lys Phe Glu Trp Phe Asp Glu Gly Leu Tyr Glu Ala
             115                 120                 125
Pro Lys Gly Tyr Ser Leu Glu Asp Leu Leu Ala Thr Val Lys Tyr Tyr
     130                 135                 140
Val Glu Pro Arg Asn Ala Ser Asp His Val Arg Lys Asn Lys Ala Asp
145                 150                 155                 160
Gln Asp Ser Lys Pro Asp Glu Asp Lys Glu His Asp Glu Val Ser Glu
                 165                 170                 175
Pro Thr His Pro Glu Ser Asp Glu Lys Glu Asn His Ala Gly Leu Asn
             180                 185                 190
Pro Ser Ala Asp Asn Leu Tyr Lys Pro Ser Thr Asp Thr Glu Glu Thr
     195                 200                 205
Glu Glu Glu Ala Glu Asp Thr Thr Asp Glu Ala Glu Ile Pro Gly Thr
     210                 215                 220
Pro Ser Ile Arg Gln Asn Ala Met Glu Thr Leu Thr Gly Leu Lys Ser
225                 230                 235                 240
Ser Leu Leu Leu Gly Thr Lys Asp Asn Asn Thr Ile Ser Ala Glu Val
                 245                 250                 255
Asp Ser Leu Leu Ala Leu Leu Lys Glu Ser Gln Pro Ala Pro Ile Gln
             260                 265                 270
(SEQ ID No11)
```

*FIG. 13*

```
Met Gln Ile Gly Gln Pro Thr Leu Pro Asn Asn Ser Leu Ala Thr Pro
 1           5                   10                  15
Ser Pro Ser Leu Pro Ile Asn Pro Gly Thr Ser His Glu Lys His Glu
             20                  25                  30
Glu Asp Gly Tyr Gly Phe Asp Ala Asn Arg Ile Ile Ala Glu Asp Glu
             35                  40                  45
Ser Gly Phe Val Met Ser His Gly Asp Ser Asn His Tyr Phe Phe Lys
     50              55                  60
Lys Asp Leu Thr Glu Glu Gln Ile Lys Ala Ala Gln Lys His Leu Glu
65                   70                  75                  80
Glu Val Lys Thr Ser His Asn Gly Leu Asp Ser Leu Ser Ser His Glu
                 85                  90                  95
Gln Asp Tyr Pro Gly Asn Ala Lys Glu Met Lys Asp Leu Asp Lys Lys
             100                 105                 110
Ile Glu Glu Lys Ile Ala Gly Ile Met Lys Gln Tyr Gly Val Lys Arg
             115                 120                 125
Glu Ser Ile Val Val Asn Lys Glu Lys Asn Ala Ile Ile Tyr Pro Ser
    130                 135                 140
Gly Asp His His His Ala Asp Pro Ile Asp Glu His Lys Pro Val Gly
145                 150                 155                 160
Ile Gly His Ser His Ser Asn Tyr Glu Leu Phe Lys Pro Glu Glu Gly
                165                 170                 175
Val Ala Lys Lys Glu Gly Asn Lys Val Tyr Thr Gly Glu Glu Leu Thr
            180                  185                 190
Asn Val Val Asn Leu Leu Lys Asn Ser Thr Phe Asn Asn Gln Asn Phe
    195                 200                 205
Thr Leu Ala Asn Gly Gln Lys Arg Val Ser Phe Ser Phe Pro Pro Glu
    210                 215                 220
Leu Glu Lys Lys Leu Gly Ile Asn Met Leu Val Lys Leu Ile Thr Pro
225                 230                 235                 240
Asp Gly Lys Val Leu Glu Lys Val Ser Gly Lys Val Phe Gly Glu Gly
            245                 250                 255
Val Gly Asn Ile Ala Asn Phe Glu Leu Asp Gln Pro Tyr Leu Pro Gly
            260                 265                 270
Gln Thr Phe Lys Tyr Thr Ile Ala Ser Lys Asp Tyr Pro Glu Val Ser
        275                 280                 285
Tyr Asp Gly Thr Phe Thr Val Pro Thr Ser Leu Ala Tyr Lys Met Ala
290                 295                 300
Ser Gln Thr Ile Phe Tyr Pro Phe His Ala Gly Asp Thr Tyr Leu Arg
305                 310                 315                 320
Val Asn Pro Gln Phe Ala Val Pro Lys Gly Thr Asp Ala Leu Val Arg
            325                 330                 335
Val Phe Asp Glu Phe His Gly Asn Ala Tyr Leu Glu Asn Asn Tyr Lys
            340                 345                 350
Val Gly Glu Ile Lys Leu Pro Ile Pro Lys Leu Asn Gln Gly Thr Thr
        355                 360                 365
```

*FIG. 14A*

```
Arg Thr Ala Gly Asn Lys Ile Pro Val Thr Phe Met Ala Asn Ala Tyr
370                 375                 380
Leu Asp Asn Gln Ser Thr Tyr Ile Val Glu Val Pro Ile Leu Glu Lys
385                 390                 395                 400
Glu Asn Gln Thr Asp Lys Pro Ser Ile Leu Pro Gln Phe Lys Arg Asn
            405                 410                 415
Lys Ala Gln Glu Asn Ser Lys Leu Asp Glu Lys Val Glu Glu Pro Lys
            420                 425                 430
Thr Ser Glu Lys Val Glu Lys Glu Lys Leu Ser Glu Thr Gly Asn Ser
        435                 440                 445
Thr Ser Asn Ser Thr Leu Glu Glu Val Pro Thr Val Asp Pro Val Gln
450                 455                 460
Glu Lys Val Ala Lys Phe Ala Glu Ser Tyr Gly Met Lys Leu Glu Asn
465                 470                 475                 480
Val Leu Phe Asn Met Asp Gly Thr Ile Glu Leu Tyr Leu Pro Ser Gly
            485                 490                 495
Glu Val Ile Lys Lys Asn Met Ala Asp Phe Thr Gly Glu Ala Pro Gln
            500                 505                 510
Gly Asn Gly Glu Asn Lys Pro Ser Glu Asn Gly Lys Val Ser Thr Gly
        515                 520                 525
Thr Val Glu Asn Gln Pro Thr Glu Asn Lys Pro Ala Asp Ser Leu Pro
530                 535                 540
Glu Ala Pro Asn Glu Lys Pro Val Lys Pro Glu Asn Ser Thr Asp Asn
545                 550                 555                 560
Gly Met Leu Asn Pro Glu Gly Asn Val Gly Ser Asp Pro Met Leu Asp
            565                 570                 575
Pro Ala Leu Glu Glu Ala Pro Ala Val Asp Pro Val Gln Glu Lys Leu
            580                 585                 590
Glu Lys Phe Thr Ala Ser Tyr Gly Leu Gly Leu Asp Ser Val Ile Phe
        595                 600                 605
Asn Met Asp Gly Thr Ile Glu Leu Arg Leu Pro Ser Gly Glu Val Ile
610                 615                 620
Lys Lys Asn Leu Ser Asp Phe Ile Ala
625                 630
(SEQ ID No12)
```

FIG. 14B

```
Met Gln Ile Thr Tyr Thr Asp Asp Glu Ile Gln Val Ala Lys Leu Ala
 1               5                   10                  15
Gly Lys Tyr Thr Thr Glu Asp Gly Tyr Ile Phe Asp Thr Ser Trp Ile
             20                  25                  30
Lys Lys Asp Ser Leu Ser Glu Ala Glu Arg Ala Ala Ala Gln Ala Tyr
             35              40                  45
Ala Lys Glu Lys Gly Leu Thr Pro Pro Ser Thr Asp His Gln Asp Ser
         50              55              60
Gly Asn Thr Glu Ala Lys Gly Ala Glu Ala Ile Tyr Asn Arg Val Lys
65                   70                  75                  80
Ala Ala Lys Lys Val Pro Leu Asp Arg Met Pro Tyr Asn Leu Gln Tyr
                 85                  90                  95
Thr Val Glu Val Lys Asn Gly Ser Leu Ile Ile Pro Asn Ile Lys Phe
                100                 105                 110
Glu Trp Phe Asp Glu Gly Leu Tyr Glu Ala Pro Lys Gly Tyr Ser Leu
             115                 120                 125
Glu Asp Leu Leu Ala Thr Val Lys Tyr Tyr Val Glu Pro Arg Asn Ala
         130                 135             140
Ser Asp His Val Arg Lys Asn Lys Ala Asp Gln Asp Ser Lys Pro Asp
145                 150                 155                 160
Glu Asp Lys Glu His Asp Glu Val Ser Glu Pro Thr His Pro Glu Ser
             165                 170                 175
Asp Glu Lys Glu Asn His Ala Gly Leu Asn Pro Ser Ala Asp Asn Leu
             180                 185                 190
Tyr Lys Pro Ser Thr Asp Thr Glu Glu Thr Glu Glu Ala Glu Asp
             195                 200             205
Thr Thr Asp Glu Ala Glu Ile Pro Gly Thr Pro Ser Ile Arg Gln Asn
         210                 215                 220
Ala Met Glu Thr Leu Thr Gly Leu Lys Ser Ser Leu Leu Leu Gly Thr
225                 230                 235                 240
Lys Asp Asn Asn Thr Ile Ser Ala Glu Val Asp Ser Leu Leu Ala Leu
                245                 250                 255
Leu Lys Glu Ser Gln Pro Ala Pro Ile Gln
             260                 265
(SEQ ID No13)
```

FIG. 15

STREPTOCOCCUS ANTIGENS

The present application incorporates by reference U.S. patent application Ser. No. 09/884,465 filed on Jun. 20, 2001, now issued as U.S. Pat. No. 7,074,415 on Jul. 11, 2006, and/or corresponding PCT CA01/00908 filed on Jun. 19, 2001. This application claims priority to U.S. Provisional Application Ser. No. 60/341,252, filed Dec. 20, 2001.

FIELD OF THE INVENTION

The present invention is related to polypeptides, antigens, epitopes and antibodies directed to these epitopes, more particularly polypeptide antigens of *Streptococcus pneumoniae* pathogen which may be useful for prophylaxis, diagnostic or treatment of streptococcal infection.

BACKGROUND OF THE INVENTION

*S. pneumoniae* is an important agent of disease in man especially among infants, the elderly and immunocompromised persons. It is a bacterium frequently isolated from patients with invasive diseases such as bacteraemia/septicaemia, pneumonia, meningitis with high morbidity and mortality throughout the world. Even with appropriate antibiotic therapy, pneumococcal infections still result in many deaths. Although the advent of antimicrobial drugs has reduced the overall mortality from pneumococcal disease, the presence of resistant pneumococcal organisms has become a major problem in the world today. Effective pneumococcal vaccines could have a major impact on the morbidity and mortality associated with *S. pneumoniae* disease. Such vaccines would also potentially be useful to prevent otitis media in infants and young children.

Efforts to develop a pneumococcal vaccine have generally concentrated on generating immune responses to the pneumococcal capsular polysaccharide. More than 80 pneumococcal capsular serotypes have been identified on the basis of antigenic differences. The currently available pneumococcal vaccine, comprising 23 capsular polysaccharides that most frequently caused disease, has significant shortcomings related primarily to the poor immunogenicity of some capsular polysaccharides, the diversity of the serotypes and the differences in the distribution of serotypes over time, geographic areas and age groups. In particular, the failure of existing vaccines and capsular conjugate vaccines currently in development to protect young children against all serotypes spurres evaluation of other *S. pneumoniae* components. Although immunogenicity of capsular polysaccharides can be improved, serotype specificity will still represent a major limitation of polysaccharide-based vaccines. The use of a antigenically conserved immunogenic pneumococcal protein antigen, either by itself or in combination with additional components, offers the possibility of a protein-based pneumococcal vaccine.

PCT WO 98/18930 published May 7, 1998 entitled "*Streptococcus Pneumoniae* antigens and vaccines" describes certain polypeptides which are claimed to be antigenic. However, no biological activity of these polypeptides is reported. Similarly, no sequence conservation is reported, which is a necessary species common vaccine candidate.

PCT WO 00/39299 describes polypeptides and polynucleotides encoding these polypeptides. PCT WO 00/39299 demonstrates that polypeptides designated as BVH-3 and BVH-11 provide protection against fatal experimental infection with pneumococci.

There remains an unmet need for *Streptococcus* antigens that may be used as components for the prophylaxis, diagnostic and/or therapy of *Streptococcus* infection.

SUMMARY OF THE INVENTION

An isolated polynucleotide comprising a polynucleotide chosen from:
(a) a polynucleotide encoding a polypeptide having at least 70% identity to a second polypeptide chosen from: SEQ ID 1, 2, 3, 90 to 115, 141 to 148 or fragments, analogs or derivatives thereof;
(b) a polynucleotide encoding a polypeptide having at least 95% identity to a second polypeptide chosen from: SEQ ID 1, 2, 3, 90 to 115, 141 to 148 or fragments, analogs or derivatives thereof;
(c) a polynucleotide encoding a polypeptide having an amino sequence chosen from SEQ ID 1, 2, 3, 90 to 115, 141 to 148 or fragments, analogs or derivatives thereof;
(d) a polynucleotide encoding a polypeptide capable of raising antibodies having binding specificity for a polypeptide having a sequence chosen from: SEQ ID 1, 2, 3, 90 to 115, 141 to 148 or fragments, analogs or derivatives thereof;
(e) a polynucleotide encoding an epitope bearing portion of a polypeptide chosen from SEQ ID 1, 2, 3, 90 to 115, 141 to 148 or fragments, analogs or derivatives thereof;
(f) a polynucleotide comprising a sequence chosen from SEQ ID NOS: 4, 5 or 6;
(g) a polynycleotide complementary to a polynucleotide in (a), (b), (c), (d), (e) or (f)

In other aspects, there are provided polypeptides encoded by polynucleotides of the invention, pharmaceutical compositions, vaccine compositions, vectors comprising polynucleotides of the invention operably linked to an expression control region, as well as host cells transfected with said vectors and processes for producing polypeptides comprising culturing said host cells under conditions suitable for expression.

BRIEF DESCRIPTION OF THE DRAWINGS

FIG. 1 represents the amino acid sequence of New 136 polypeptide; SEQ ID NO: 1.

FIG. 2 represents the amino acid sequence of VP 139 (also called New 139 when fused to an Histidine tag) polypeptide; SEQ ID NO: 2.

FIG. 3 represents the amino acid sequence of VP147 (also called New 147 when fused to an Histidine tag) polypeptide; SEQ ID NO: 3.

FIG. 4 represents the DNA sequence of New 136 gene; SEQ ID NO: 4.

FIG. 5 represents the DNA sequence of New 139 (also called VP139) gene; SEQ ID NO: 5.

Figure 6:
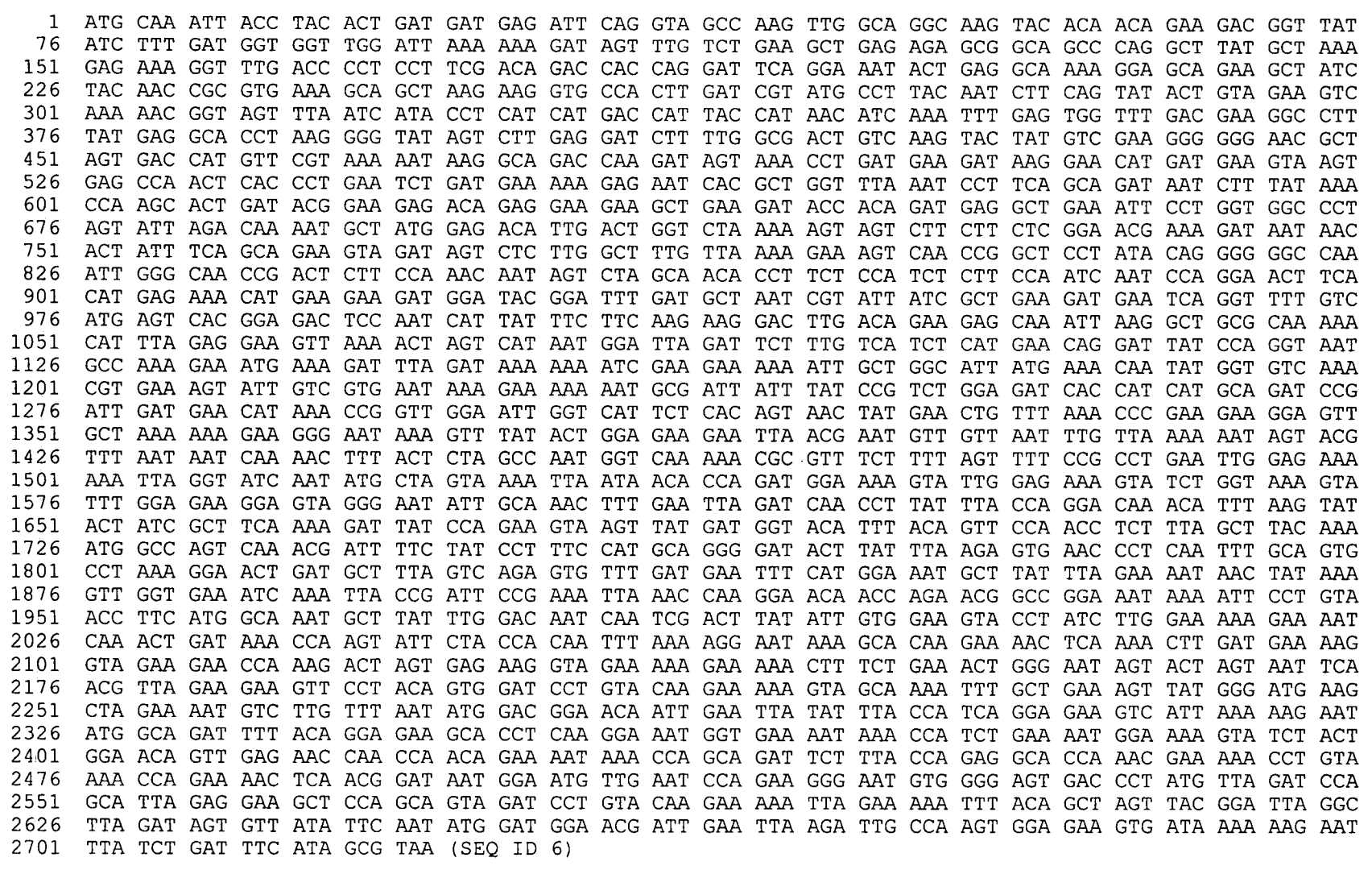

FIG. 6 represents the DNA sequence of VP147 (also called New 147) gene; SEQ ID NO: 6.

FIG. 8A-8D depicts the comparison of the amino acid sequences of VP147 (SEQ ID NO:149), VP147-R1 (SEQ ID NO:150), VP147-R2 (SEQ ID NO:151), VP147-R3 (SEQ ID NO:152), VP147-L1 (SEQ ID NO:153), VP147-L2 (SEQ ID NO:154), VP-147-L3 (SEQ ID NO:155), VP147-L4 (SEQ ID NO:156), and VP147-R2-L4 (SEQ ID NO:157) by using the program Align X from Vector NTI® sequence analysis software (version 7.0). The consensus sequence corresponds to the sequence set forth in SEQ ID NO:158.

FIG. 9A-9C represents the amino acid sequence of BVH-3 polypeptide; SEQ ID NO: 7.

FIG. 10A-10C represents the amino acid sequence of BVH-11 polypeptide; SEQ ID NO: 8.

FIG. 11A-11C represents the amino acid sequence of BVH-11-2 polypeptide; SEQ ID NO: 9.

FIG. 12 represents the DNA sequence of New 43 gene; SEQ ID NO: 10.

FIG. 13 represents the amino acid sequence of New 43 polypeptide; SEQ ID NO: 11.

FIG. 14A-14B represents the amino acid sequence of New 56 polypeptide; SEQ ID NO: 12.

FIG. 15 represents the amino acid sequence of New88 polypeptide; SEQ ID NO: 13.

DETAILED DESCRIPTION OF THE INVENTION

Figure 7:
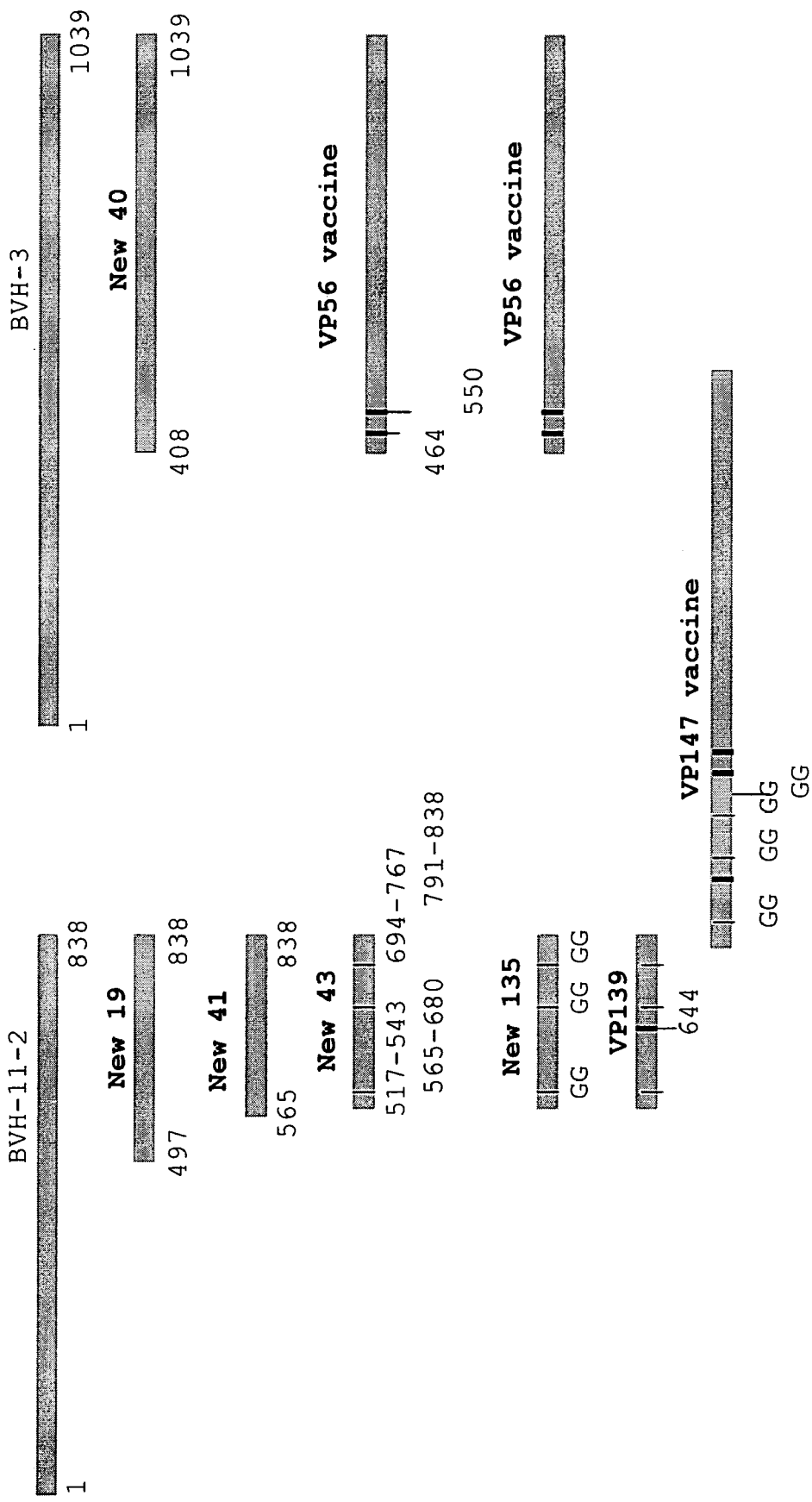
FIG. 7 illustrates the construct evolution from BVH-3 and BVH-11-2 to the chimeric VP147.

It was determined that portions of the BVH-3 and BVH-11 polypeptides were internal. Other portions were not present in important strains such as encapsulated *S.pneumoniae* causing disease strains. When large portions of a polypeptide are internal, these portions are not exposed on the bacteria. However, these portions can be very immunogenic in a recombinant polypeptide and will not confer protection against infections. It would be advantageous to have a polypeptide that comprises a portion that is not internal. It would also be advantageous to have a polypeptide that comprises a portion that is present in most strains.

The present invention is concerned with polypeptides in which undesired portions have been deleted and/or modified in order to obtain a specific immune response.

The polypeptides designated NEW include additional tag sequences at the carboxyl end. In contrast, the polypeptides designated VP are produced with another expression vector and therefore do not have a His tag.

In accordance with the present invention, there are also provided polypeptides or polynucleotides encoding such polypeptides comprising protective domains.

Surprisingly, when specific portions of the polypeptides are deleted or modified, the polypeptides have desired biological properties. This is surprising in view of the fact that some of these portions were described as being epitope bearing portion in the patent application PCT WO 98/18930. In other publications such as PCT WO 00/37105, portions identified as histidine triad and coil coiled regions were said to be of importance. The present inventors have found that variants of the polypeptide BVH-3 and BVH-11 in which certain portions were deleted and/or modified and chimeras of these polypeptides have biological properties and generate a specific immune response.

According to one aspect, the present invention provides an isolated polynucleotide encoding a polypeptide having at least 70% identity to a second polypeptide comprising a sequence as disclosed in the present application, the tables and figures. According to one aspect, the present invention provides an isolated polynucleotide encoding a polypeptide having at least 80% identity to a second polypeptide comprising a sequence as disclosed in the present application, the tables and figures.

According to one aspect, the present invention provides an isolated polynucleotide encoding a polypeptide having at least 90% identity to a second polypeptide comprising a sequence as disclosed in the present application, the tables and figures.

According to one aspect, the present invention provides an isolated polynucleotide encoding a polypeptide having at least 98% identity to a second polypeptide comprising a sequence as disclosed in the present application, the tables and figures.

According to one aspect, the present invention provides an isolated polynucleotide encoding a polypeptide having at least 99% identity to a second polypeptide comprising a sequence as disclosed in the present application, the tables and figures.

According to one aspect, the present invention provides an isolated polynucleotide encoding a polypeptide comprising a sequence as disclosed in the present application, the tables and figures.

In accordance with one aspect of the present invention, there is provided an isolated polynucleotide comprising a polynucleotide chosen from;
  (a) a polynucleotide encoding a polypeptide having at least 70% identity to a second polypeptide chosen from: SEQ ID 1, 2, 3, 90 to 115, 141 to 148 or fragments, analogs or derivatives thereof;
  (b) a polynucleotide encoding a polypeptide having at least 95% identity to a second polypeptide chosen from: SEQ ID 1, 2, 3, 90 to 115, 141 to 148 or fragments, analogs or derivatives thereof;
  (c) a polynucleotide encoding a polypeptide having an amino sequence chosen from SEQ ID 1, 2, 3, 90 to 115, 141 to 148 or fragments, analogs or derivatives thereof;
  (d) a polynucleotide encoding a polypeptide capable of raising antibodies having binding specificity for a polypeptide having a sequence chosen from: SEQ ID 1, 2, 3, 90 to 115, 141 to 148 or fragments, analogs or derivatives thereof;
  (e) a polynucleotide encoding an epitope bearing portion of a polypeptide chosen from SEQ ID 1, 2, 3, 90 to 115, 141 to 148 or fragments, analogs or derivatives thereof;
  (f) a polynucleotide comprising a sequence chosen from SEQ ID NOS: 4, 5, 6 or fragments, analogs or derivatives thereof;
  (g) a polynycleotide complementary to a polynucleotide in (a), (b), (c), (d), (e) or (f).

In accordance with one aspect of the present invention, there is provided an isolated polynucleotide comprising a polynucleotide chosen from;
  (a) a polynucleotide encoding a polypeptide having at least 70% identity to a second polypeptide chosen from: SEQ ID 1, 2, 3, 90 to 115 or 141 to 148;
  (b) a polynucleotide encoding a polypeptide having at least 95% identity to a second polypeptide chosen from: SEQ ID 1, 2, 3, 90 to 115 or 141 to 148;
  (c) a polynucleotide encoding a polypeptide having an amino sequence chosen from SEQ ID 1, 2, 3, 90 to 115 or 141 to 148;
  (d) a polynucleotide encoding a polypeptide capable of raising antibodies having binding specificity for a polypeptide having a sequence chosen from: SEQ ID 1, 2, 3, 90 to 115 or 141 to 148;
  (e) a polynucleotide encoding an epitope bearing portion of a polypeptide chosen from SEQ ID 1, 2, 3, 90 to 115 or 141 to 148;
  (f) a polynucleotide comprising a sequence chosen from SEQ ID NOS: 4, 5 or 6; and
  (g) a polynycleotide complementary to a polynucleotide in (a), (b), (c), (d), (e) or (f).

According to one aspect, the present invention provides an isolated polynucleotide encoding a polypeptide having at least 70% identity to a second polypeptide comprising a sequence chosen from SEQ ID 1, 2, 3, 90 to 115, 141 to 148 or fragments, analogues or derivatives thereof.

According to one aspect, the present invention provides an isolated polynucleotide encoding a polypeptide having at least 95% identity to a second polypeptide comprising a sequence chosen from SEQ ID 1, 2, 3, 90 to 115, 141 to 148 or fragments, analogues or derivatives thereof.

According to one aspect, the present invention provides an isolated polynucleotide encoding a polypeptide having at least 98% identity to a second polypeptide comprising a sequence chosen from SEQ ID 1, 2, 3, 90 to 115, 141 to 148 or fragments, analogues or derivatives thereof.

According to one aspect, the present invention provides an isolated polynucleotide encoding a polypeptide having at least 99% identity to a second polypeptide comprising a sequence chosen from SEQ ID 1, 2, 3, 90 to 115, 141 to 148 or fragments, analogues or derivatives thereof.

According to one aspect, the present invention provides an isolated polynucleotide encoding a polypeptide having a sequence chosen from SEQ ID 1, 2, 3, 90 to 115, 141 to 148 or fragments, analogues or derivatives thereof.

According to one aspect, the present invention relates to polypeptides characterised by the amino acid sequence chosen from SEQ ID 1, 2, 3, 90 to 115, 141 to 148 or fragments, analogues or derivatives thereof.

According to one aspect, the present invention provides an isolated polynucleotide having a sequence comprising a sequence chosen from SEQ ID Nos: 4, 5, 6 or fragments or analogs thereof;

According to one aspect, the present invention provides an isolated polynucleotide encoding a polypeptide having at least 70% identity to a second polypeptide comprising a sequence chosen from SEQ ID 1, 2, 3, 90 to 115 or 141 to 148.

According to one aspect, the present invention provides an isolated polynucleotide encoding a polypeptide having at least 95% identity to a second polypeptide comprising a sequence chosen from SEQ ID 1, 2, 3, 90 to 115 or 141 to 148.

According to one aspect, the present invention provides an isolated polynucleotide encoding a polypeptide having at least 98% identity to a second polypeptide comprising a sequence chosen from SEQ ID 1, 2, 3, 90 to 115 or 141 to 148.

According to one aspect, the present invention provides an isolated polynucleotide encoding a polypeptide having at least 99% identity to a second polypeptide comprising a sequence chosen from SEQ ID 1, 2, 3, 90 to 115 or 141 to 148.

According to one aspect, the present invention provides an isolated polynucleotide encoding a polypeptide having a sequence chosen from SEQ ID 1, 2, 3, 90 to 115 or 141 to 148.

According to one aspect, the present invention relates to polypeptides characterised by the amino acid sequence chosen from SEQ ID 1, 2, 3, 90 to 115 or 141 to 148.

According to one aspect, the present invention provides an isolated polynucleotide having a sequence comprising a sequence chosen from SEQ ID Nos: 4, 5 or 6.

According to one aspect, the present invention relates to an isolated polypeptide comprising a polypeptide chosen from:

(a) a polypeptide having at least 70% identity to a second polypeptide having an amino acid sequence chosen from: SEQ ID NO: 1, 2, 3, 90 to 115, 141 to 148 or fragments, analogs or derivatives thereof;

(b) a polypeptide having at least 95% identity to a second polypeptide having an amino acid sequence chosen from: SEQ ID NO: 1, 2, 3, 90 to 115, 141 to 148 or fragments, analogs or derivatives thereof;

(c) a polypeptide having an amino acid sequence chosen from SEQ ID NO: 1, 2, 3, 90 to 115, 141 to 148 or fragments, analogs or derivatives thereof;

(d) a polypeptide capable of raising antibodies having binding specificity for a second polypeptide having a sequence chosen from SEQ ID NO: 1, 2, 3, 90 to 115, 141 to 148 or fragments, analogs or derivatives thereof;

(e) an epitope bearing portion of a polypeptide having an amino acid sequence chosen from: SEQ ID NO: 1, 2, 3, 90 to 115, 141 to 148 or fragments, analogs or derivatives thereof;

(f) the polypeptide of (a), (b), (c), (d) or (e) wherein the N-terminal Met residue is deleted; or (g) the polypeptide of (a), (b), (c), (d), (e) or (f) wherein the secretory amino acid sequence is deleted.

According to one aspect, the present invention relates to an isolated polypeptide comprising a member chosen from:

(a) a polypeptide having at least 70% identity to a second polypeptide having an amino acid sequence chosen from: SEQ ID NO: 1, 2, 3, 90 to 115 or 141 to 148;

(b) a polypeptide having at least 95% identity to a second polypeptide having an amino acid sequence chosen from: SEQ ID NO: 1, 2, 3, 90 to 115 or 141 to 148;

(c) a polypeptide having an amino acid sequence chosen from SEQ ID NO: 1, 2, 3, 90 to 115 or 141 to 148;

(d) a polypeptide capable of raising antibodies having binding specificity for a second polypeptide having a sequence chosen from SEQ ID NO: 1, 2, 3, 90 to 115 or 141 to 148;

(e) an epitope bearing portion of a polypeptide having an amino acid sequence chosen from: SEQ ID NO: 1, 2, 3, 90 to 115 or 141 to 148;

(f) the polypeptide of (a), (b), (c), (d) or (e) wherein the N-terminal Met residue is deleted; or (g) the polypeptide of (a), (b), (c), (d), (e), or (f) wherein the secretory amino acid sequence is deleted.

A BVH-11-2 polypeptide construction is made up of 4 fragments (A, B, C, D) from the original BVH-11 polypeptide described in PCT WO 00/39299, linked by 3 fusion sites: - - - A - - - fusion site - - - B - - - fusion site - - - C - - - fusion site - - -D - - -

These fusion sites were in fact depending on the restriction enzyme chosen.

In NEW 139 these 3 fusion sites have been mutated for pairs of Glycine residues to facilitate movement and reduce the possibility of creating new epitopes.

In accordance with the present invention, all nucleotides of the present invention encoding polypeptides and chimeric polypeptides are within the scope of the present invention.

In a further embodiment, the present invention relates to chimeric polypeptides made of at least 2 polypeptides, the first one contains a Methionine codon for translation, the following ones do not need to start with a Methionine codon.

A stop codon can be added at the end of the chimeric polypeptide so that the polypeptides are produced without a tag.

In a further embodiment, the present invention relates to chimeric polypeptides comprising to or more polypeptides comprising a sequence chosen from SEQ ID NOS: 1, 2, 3, 90 to 115 or 141 to 148 or fragments, analogs or derivatives thereof provided that the polypeptides are linked as to form a chimeric polypeptide.

In a further embodiment, the present invention relates to chimeric polypeptides comprising to or more polypeptides comprising a sequence chosen from SEQ ID NOS: 1, 2, 3, 90 to 115 or 141 to 148 provided that the polypeptides are linked as to form a chimeric polypeptide.

In a further embodiment, the chimeric polypeptide is made of at least 2 polypeptides, chosen from BVH-3, BVH-11-1 and/or BVH-11-2 polypeptides.

In a preferred embodiment, the chimeras are made up of a BVH-3 fragment and a BVH-11-2 fragment linked together by optional amino acids such as Glycine-Proline or Glycine-Glycine.

In VP 147, which is a chimera, made up of VP56 (or New56) and NEW 139, these 2 fragments are linked by glycine residues (GG).

Those skilled in the art will appreciate that the invention includes DNA molecules, i.e. polynucleotides and their complementary sequences that encode analogs such as mutants, variants, homologues and derivatives of such polypeptides, as described herein in the present patent application. The invention also includes RNA molecules corresponding to the DNA molecules of the invention. In addition to the DNA and RNA molecules, the invention includes the corresponding polypeptides and monospecific antibodies that specifically bind to such polypeptides.

In a further embodiment, the polypeptides or chimeric polypeptides in accordance with the present invention are antigenic.

In a further embodiment, the polypeptides or chimeric polypeptides in accordance with the present invention are immunogenic.

In a further embodiment, the polypeptides or chimeric polypeptides in accordance with the present invention can elicit an immune response in an individual.

In a further embodiment, the present invention also relates to polypeptides which are able to raise antibodies having binding specificity to the polypeptides or chimeric polypeptides of the present invention as defined above.

In one embodiment, the polypeptides of the invention comprise at least one epitope bearing portion.

In a further embodiment, the fragments of the polypeptides of the present invention will comprise at least 10 contiguous amino acid of the polypeptides of SEQ ID NO 1, 2, 3, 90 to 115 or 141 to 148. The fragment will comprises at least 15 contiguous amino acid of the polypeptides of SEQ ID NO 1, 2, 3, 90 to 115 or 141 to 148. The fragment will comprises at least 20 contiguous amino acid of the polypeptides of SEQ ID NO 1, 2, 3, 90 to 115 or 141 to 148.

An antibody that "has binding specificity" is an antibody that recognises and binds the selected polypeptide but which does not substantially recognise and bind other molecules in a sample, such as a biological sample. Specific binding can be measured using an ELISA assay in which the selected polypeptide is used as an antigen.

In accordance with the present invention, "protection" in the biological studies is defined by a significant increase in the survival curve, rate or period. Statistical analysis using the Log rank test to compare survival curves, and Fisher exact test to compare survival rates and numbers of days to death, respectively, might be useful to calculate P values and determine whether the difference between the two groups is statistically significant. P values smaller than 0.05 are regarded as not significant.

As used herein, "fragments", "derivatives" or "analogues" of the polypeptides of the invention include those polypeptides in which one or more of the amino acid residues are substituted with a conserved or non-conserved amino acid residue (preferably conserved) and which may be natural or unnatural. In one embodiment, derivatives and analogues of polypeptides of the invention will have about 70% identity with those sequences illustrated in the figures or fragments thereof. That is, 70% of the residues are the same. In a further embodiment, polypeptides will have greater than 75% homology. In a further embodiment, polypeptides will have greater than 80% homology. In a further embodiment, polypeptides will have greater than 85% homology. In a further embodiment, polypeptides will have greater than 90% homology. In a further embodiment, polypeptides will have greater than 95% homology. In a further embodiment, polypeptides will have greater than 99% homology. In a further embodiment, derivatives and analogues of polypeptides of the invention will have less than about 20 amino acid residue substitutions, modifications or deletions and more preferably less than 10. Preferred substitutions are those known in the art as conserved i.e. the substituted residues share physical or chemical properties such as hydrophobicity, size, charge or functional groups.

The skilled person will appreciate that analogues or derivatives of the proteins or polypeptides of the invention will also find use in the context of the present invention, i.e. as antigenic/immunogenic material. Thus, for instance proteins or polypeptides which include one or more additions, deletions, substitutions or the like are encompassed by the present invention. In addition, it may be possible to replace one amino acid with another of similar "type". For instance replacing one hydrophobic amino acid with another hydrophilic amino acid.

One can use a program such as the CLUSTAL program to compare amino acid sequences. This program compares amino acid sequences and finds the optimal alignment by inserting spaces in either sequence as appropriate. It is possible to calculate amino acid identity or similarity (identity plus conservation of amino acid type) for an optimal alignment. A program like BLASTx will align the longest stretch of similar sequences and assign a value to the fit. It is thus possible to obtain a comparison where several regions of similarity are found, each having a different score. Both types of identity analysis are contemplated in the present invention.

It is well known that it is possible to screen an antigenic polypeptide to identify epitopic regions, i.e. those regions which are responsible for the polypeptide's antigenicity or immunogenicity. Methods for carrying out such screening are well known in the art. Thus, the fragments of the present invention should include one or more such epitopic regions or be sufficiently similar to such regions to retain their antigenic/immunogenic properties.

In an alternative approach, the analogues or derivatives could be fusion proteins, incorporating moieties which render purification easier, for example by effectively tagging the desired protein or polypeptide, It may be necessary to remove the "tag" or it may be the case that the fusion protein itself retains sufficient antigenicity to be useful.

In an additional aspect of the invention there are provided antigenic/immunogenic fragments of the proteins or polypeptides of the invention, or of analogues or derivatives thereof.

The fragments of the present invention should include one or more such epitopic regions or be sufficiently similar to such regions to retain their antigenic/immunogenic properties. Thus, for fragments according to the present invention the degree of identity is perhaps irrelevant, since they may be 100% identical to a particular part of a protein or polypeptide, analogue or derivative as described herein. The key issue, once again, is that the fragment retains the antigenic/immunogenic properties.

Thus, what is important for analogues, derivatives and fragments is that they possess at least a degree of the antigenicity/immunogenic of the protein or polypeptide from which they are derived.

In accordance with the present invention, polypeptides of the invention include both polypeptides and chimeric polypeptides.

Also included are polypeptides which have fused thereto other compounds which alter the polypeptides biological or pharmacological properties i.e. polyethylene glycol (PEG) to increase half-life; leader or secretory amino acid sequences for ease of purification; prepro- and pro-sequences; and (poly)saccharides.

Furthermore, in those situations where amino acid regions are found to be polymorphic, it may be desirable to vary one or more particular amino acids to more effectively mimic the different epitopes of the different *Streptococcus* strains.

Moreover, the polypeptides of the present invention can be modified by terminal —$NH_2$ acylation (e.g. by acetylation, or thioglycolic acid amidation, terminal carboxy amidation, e.g. with ammonia or methylamine) to provide stability, increased hydrophobicity for linking or binding to a support or other molecule.

Also contemplated are hetero and homo polypeptide multimers of the polypeptide fragments, analogues and derivatives. These polymeric forms include, for example, one or more polypeptides that have been cross-linked with cross-linkers such as avidin/biotin, gluteraldehyde or dimethylsuperimidate. Such polymeric forms also include polypeptides containing two or more tandem or inverted contiguous sequences, produced from multicistronic mRNAs generated by recombinant DNA technology.

Preferably, a fragment, analogue or derivative of a polypeptide of the invention will comprise at least one antigenic region i.e. at least one epitope.

In order to achieve the formation of antigenic polymers (i.e. synthetic multimers), polypeptides may be utilised having bishaloacetyl groups, nitroarylhalides, or the like, where the reagents being specific for thio groups. Therefore, the link between two mercapto groups of the different peptides may be a single bond or may be composed of a linking group of at least two, typically at least four, and not more than 16, but usually not more than about 14 carbon atoms.

In a particular embodiment, polypeptide fragments, analogues and derivatives of the invention do not contain a methionine (Met) or valine (Val) starting residue. Preferably, polypeptides will not incorporate a leader or secretory sequence (signal sequence). The signal portion of a polypeptide of the invention may be determined according to established molecular biological techniques. In general, the polypeptide of interest may be isolated from a *Streptococcus* culture and subsequently sequenced to determine the initial residue of the mature protein and therefore the sequence of the mature polypeptide.

According to another aspect of the invention, there are also provided (i) a composition of matter containing a polypeptide of the invention, together with a carrier, diluent, adjuvant or liposome; (ii) a pharmaceutical composition comprising a polypeptide of the invention and a pharmaceutically acceptable carrier, diluent, adjuvant or liposome; (iii) a vaccine comprising a polypeptide of the invention and a pharmaceutically acceptable carrier, diluent, adjuvant or liposome; (iv) a method for inducing an immune response against *Streptococcus*, in a host, by administering to the host, an immunogenically effective amount of a polypeptide of the invention to elicit an immune response, e.g., a protective immune response to *Streptococcus*; and particularly, (v) a method for preventing and/or treating a *Streptococcus* infection, by administering a prophylactic or therapeutic amount of a polypeptide of the invention to a host in need; and (vi) a method for preventing and/or treating a *Streptococcus* infection by administering a prophylactic or therapeutic amount of an antibody directed to a polypeptide of the invention to a host in need.

According to another aspect of the invention, there are also provided (i) a composition of matter containing a polynucleotide of the invention, together with a carrier, diluent, adjuvant or liposome; (ii) a pharmaceutical composition comprising a polynucleotide of the invention and a pharmaceutically acceptable carrier, diluent, adjuvant or liposome; (iii) a method for inducing an immune response against *Streptococcus*, in a host, by administering to the host, an immunogenically effective amount of a polynucleotide of the invention to elicit an immune response, e.g., a protective immune response to *Streptococcus*; and particularly, (iv) a method for preventing and/or treating a *Streptococcus* infection, by administering a prophylactic or therapeutic amount of a polynucleotide of the invention to a host in need.

Before immunization, the polypeptides of the invention can also be coupled or conjugated to carrier proteins such as tetanus toxin, diphtheria toxin, hepatitis B virus surface antigen, poliomyelitis virus VP1 antigen or any other viral or bacterial toxin or antigen or any suitable proteins to stimulate the development of a stronger immune response. This coupling or conjugation can be done chemically or genetically. A more detailed description of peptide-carrier conjugation is available in Van Regenmortel, M. H. V., Briand J. P., Muller S., Plaué S., <<Synthetic Polypeptides as antigens>> in Laboratory Techniques in Biochemistry and Molecular Biology, Vol.19 (ed.) Burdou, R. H. & Van Knippenberg P. H. (1988), Elsevier New York.

According to another aspect, there are provided pharmaceutical compositions comprising one or more *Streptococcus* polypeptides of the invention in a mixture with a pharmaceutically acceptable adjuvant. Suitable adjuvants include (1) oil-in-water emulsion formulations such as MF59™, SAF™, Ribi™; (2) Freund's complete or incomplete adjuvant; (3) salts i.e. $AlK(SO_4)_2$, $AlNa(SO_4)_2$, $AlNH_4(SO_4)_2$, $Al(OH)_3$, $AlPO_4$, silica, kaolin; (4) saponin derivatives such as Stimulon™ or particles generated therefrom such as ISCOMs (immunostimulating complexes); (5) cytokines such as interleukins, interferons, macrophage colony stimulating factor (M-CSF), tumor necrosis factor (TNF); (6) other substances such as carbon polynucleotides i.e. poly IC and poly AU, detoxified cholera toxin (CTB) and *E. coli* heat labile toxin for induction of mucosal immunity; (7) liposomes. A more detailed description of adjuvant is available in a review by M. Z. I Khan et al. in Pharmaceutical Research, vol. 11, No. 1 (1994) pp 2-11, and also in another review by Gupta et al., in Vaccine, Vol. 13, No. 14, pp 1263-1276 (1995) and in WO 99/24578. Preferred adjuvants include QuilA™, QS21™, Alhydrogel™ and Adjuphos™.

According to another aspect, there are provided pharmaceutical compositions comprising one or more *Streptococcus* polypeptides of the invention in admixture with a pharmaceutically acceptable carrier diluent or adjuvant. Suitable adjuvants include oils i.e. Freund's complete or incomplete adjuvant; salts i.e. $AlK(SO_4)_2$, $AlNa(SO_4)_2$, $AlNH_4(SO_4)_2$, silica, kaolin, carbon polynucleotides i.e. poly IC and poly AU. Preferred adjuvants include QuilA and Alhydrogel.

Pharmaceutical compositions or vaccines of the invention may be administered parenterally by injection, rapid infusion, nasopharyngeal absorption, dermoabsorption, or bucal or oral.

Pharmaceutically acceptable carriers also include tetanus toxoid.

The term "pharmaceutical composition" is also meant to include antibodies. In accordance with the present invention, there is also provided the use of one or more antibodies having binding specificity for the polypeptides of the present invention for the treatment or prophylaxis of Streptococcus infection and/or diseases and symptoms mediated by Streptococcus infection.

Pharmaceutical compositions of the invention are used for the treatment or prophylaxis of Streptococcus infection and/or diseases and symptoms mediated by Streptococcus infection as described in P. R. Murray (Ed, in chief), E. J. Baron, M. A. Pfaller, F. C. Tenover and R. H. Yolken. Manual of Clinical Microbiology, ASM Press, Washington, D.C. sixth edition, 1995, 1482p which are herein incorporated by reference. In one embodiment, vaccine compositions of the present invention are used for the treatment or prophylaxis of meningitis, otitis media, bacteremia or pneumonia.

In one embodiment, the invention provides a method for therapeutic or prophylactic treatment of meningitis, otitis media, bacteremia or pneumonia infection in an individual susceptible to meningitis, otitis media, bacteremia or pneumonia infection comprising administering to said individual a therapeutic or prophylactic amount of a composition of the invention.

In one embodiment, the invention provides a method for therapeutic or prophylactic treatment of streptococcal bacterial infection in an individual susceptible to streptococcal infection comprising administering to said individual a therapeutic or prophylactic amount of a composition of the invention.

In one embodiment, pharmaceutical compositions, or vaccine compositions of the invention are used for the treatment or prophylaxis of *streptococcus* infection and/or diseases and symptoms mediated by *streptococcus* infection, in particular *S. pneumoniae*, group A *streptococcus* (*pyogenes*), group B streptococcus (GBS or *agalactiae*), *dysgalactiae, uberis, nocardia* as well as *Staphylococcus aureus*. In a further embodiment, the *Streptococcus* infection is *S. pneumoniae*.

In a particular embodiment, pharmaceutical compositions are administered to those individuals at risk of *Streptococcus* infection such as infants, elderly and immunocompromised individuals.

As used in the present application, the term "individuals" include mammals. In a further embodiment, the mammal is human.

Pharmaceutical compositions are preferably in unit dosage form of about 0.001 to 100 µg/kg (antigen/body weight) and more preferably 0.01 to 10 µg/kg and most preferably 0.1 to 1 µg/kg 1 to 3 times with an interval of about 1 to 6 week intervals between immunizations.

Pharmaceutical compositions are preferably in unit dosage form of about 0.1 µg to 10 mg and more preferably 1 µg to 1 mg and most preferably 10 to 100 µg 1 to 3 times with an interval of about 1 to 6 week intervals between immunizations.

It will be appreciated that the polynucleotide sequences illustrated in the figures may be altered with degenerate codons yet still encode the polypeptides of the invention. Accordingly the present invention further provides polynucleotides which hybridise to the polynucleotide sequences herein above described (or the complement sequences thereof) having 50% identity between sequences. In one embodiment, at least 70% identity between sequences. In one embodiment, at least 75% identity between sequences. In one embodiment, at least 80% identity between sequences. In one embodiment, at least 85% identity between sequences. In one embodiment, at least 90% identity between sequences. In a further embodiment, polynucleotides are hybridizable under stringent conditions i.e. having at least 95% identity. In a further embodiment, more than 97% identity.

Suitable stringent conditions for hybridation can be readily determined by one of skilled in the art (see for example Sambrook et al., (1989) Molecular cloning: A Laboratory Manual, $2^{nd}$ ed, Cold Spring Harbor, N.Y.; Current Protocols in Molecular Biology, (1999) Edited by Ausubel F. M. et al., John Wiley & Sons, Inc., N.Y.).

In a further embodiment, the present invention provides polynucleotides that hybridise under stringent conditions to either
 (a) a DNA sequence encoding a polypeptide or
 (b) the complement of a DNA sequence encoding a polypeptide;

wherein said polypeptide comprising a sequence chosen from SEQ ID 1, 2, 3, 90 to 115 or 141 to 148 or fragments or analogues thereof.

In a further embodiment, the present invention provides polynucleotides that hybridise under stringent conditions to either
 (a) a DNA sequence encoding a polypeptide or
 (b) the complement of a DNA sequence encoding a polypeptide;

wherein said polypeptide comprising a sequence chosen from SEQ ID 1, 2, 3, 90 to 115 or 141 to 148.

In a further embodiment, the present invention provides polynucleotides that hybridise under stringent conditions to either
 (a) a DNA sequence encoding a polypeptide or
 (b) the complement of a DNA sequence encoding a polypeptide;

wherein said polypeptide comprises at least 10 contiguous amino acid residues from a polypeptide comprising a sequence chosen from SEQ ID 1, 2, 3, 90 to 115 or 141 to 148 or fragments or analogues thereof.

In a further embodiment, the present invention provides polynucleotides that hybridise under stringent conditions to either
 (a) a DNA sequence encoding a polypeptide or
 (b) the complement of a DNA sequence encoding a polypeptide;

wherein said polypeptide comprises at least 10 contiguous amino acid residues from a polypeptide comprising a sequence chosen from SEQ ID 1, 2, 3, 90 to 115 or 141 to 148.

As will be readily appreciated by one skilled in the art, polynucleotides include both DNA and RNA.

The present invention also includes polynucleotides complementary to the polynucleotides described in the present application.

In a further aspect, polynucleotides encoding polypeptides of the invention, or fragments, analogues or derivatives thereof, may be used in a DNA immunization method. That is, they can be incorporated into a vector which is replicable and expressible upon injection thereby producing the antigenic polypeptide in vivo. For example polynucleotides may be incorporated into a plasmid vector under the control of the CMV promoter which is functional in eukaryotic cells. Preferably the vector is injected intramuscularly.

According to another aspect, there is provided a process for producing polypeptides of the invention by recombinant techniques by expressing a polynucleotide encoding said polypeptide in a host cell, culturing said host cell under conditions suitable for expression of said polypeptide and recovering the expressed polypeptide product. Alternatively, the polypeptides can be produced according to established synthetic chemical techniques i.e. solution phase or solid phase synthesis of oligopeptides which are ligated to produce the full polypeptide (block ligation).

General methods for obtention and evaluation of polynucleotides and polypeptides are described in the following references: Sambrook et al, Molecular Cloning: A Laboratory Manual, $2^{nd}$ ed, Cold Spring Harbor, N.Y., 1989; Current Protocols in Molecular Biology, Edited by Ausubel F. M. et al., John Wiley and Sons, Inc. New York; PCR Cloning Protocols, from Molecular Cloning to Genetic Engineering, Edited by White B. A., Humana Press, Totowa, N.J., 1997, 490 pages; Protein Purification, Principles and Practices, Scopes R. K., Springer-Verlag, New York, $3^{rd}$ Edition, 1993, 380 pages; Current Protocols in Immunology, Edited by Coligan J. E. et al., John Wiley & Sons Inc., New York which are herein incorporated by reference.

For recombinant production, host cells are transfected with vectors which encode the polypeptide, and then cultured in a nutrient media modified as appropriate for activating promoters, selecting transformants or amplifying the genes. Suitable vectors are those that are viable and replicable in the chosen host and include chromosomal, non-chromosomal and synthetic DNA sequences e.g. bacterial plasmids, phage DNA, baculovirus, yeast plasmids, vectors derived from combinations of plasmids and phage DNA. The polypeptide sequence may be incorporated in the vector at the appropriate site using restriction enzymes such that it is operably linked to an expression control region comprising a promoter, ribosome binding site (consensus region or Shine-Dalgarno sequence), and optionally an operator (control element). One can select individual components of the expression control region that are appropriate for a given host and vector according to established molecular biology principles (Sambrook et al, Molecular Cloning: A Laboratory Manual, $2^{nd}$ ed, Cold Spring Harbor, N.Y., 1989; Current Protocols in Molecular Biology, Edited by Ausubel F. M. et al., John Wiley and Sons, Inc. New York incorporated herein by reference). Suitable promoters include but are not limited to LTR or SV40 promoter, E. coli lac, tac or trp promoters and the phage lambda $P_L$ promoter. Vectors will preferably incorporate an origin of replication as well as selection markers i.e. ampicilin resistance gene. Suitable bacterial vectors include pET, pQE70, pQE60, pQE-9, pbs, pD10 phagescript, psiX174, pbluescript SK, pbsks, pNH8A, pNH16a, pNH18A, pNH46A, ptrc99a, pKK223-3, pKK233-3, pDR540, pRIT5 and eukaryotic vectors pBlueBacIII, pWLNEO, pSV2CAT, pOG44, pXT1, pSG, pSVK3, pBPV, pMSG and pSVL. Host cells may be bacterial i.e. *E. coli, Bacillus subtilis, Streptomyces*; fungal i.e. *Aspergillus niger, Aspergillus nidulins*; yeast i.e. *Saccharomyces* or eukaryotic i.e. CHO, COS.

Upon expression of the polypeptide in culture, cells are typically harvested by centrifugation then disrupted by physical or chemical means (if the expressed polypeptide is not secreted into the media) and the resulting crude extract retained to isolate the polypeptide of interest. Purification of the polypeptide from culture media or lysate may be achieved by established techniques depending on the properties of the polypeptide i.e. using ammonium sulfate or ethanol precipitation, acid extraction, anion or cation exchange chromatography, phosphocellulose chromatography, hydrophobic interaction chromatography, hydroxylapatite chromatography and lectin chromatography. Final purification may be achieved using HPLC.

The polypeptide may be expressed with or without a leader or secretion sequence. In the former case the leader may be removed using post-translational processing (see U.S. Pat. No. 4,431,739; U.S. Pat. No. 4,425,437; and U.S. Pat. No. 4,338,397 incorporated herein by reference) or be chemically removed subsequent to purifying the expressed polypeptide.

According to a further aspect, the *Streptococcus* polypeptides of the invention may be used in a diagnostic test for *Streptococcus* infection, in particular *S. pneumoniae* infection.

Several diagnostic methods are possible, for example detecting *streptococcus* organism in a biological sample, the following procedure may be followed:

a) obtaining a biological sample from a patient;

b) incubating an antibody or fragment thereof reactive with a *Streptococcus* polypeptide of the invention with the biological sample to form a mixture; and c) detecting specifically bound antibody or bound fragment in the mixture which indicates the presence of *streptococcus*.

Alternatively, a method for the detection of antibody specific to a *streptococcus* antigen in a biological sample containing or suspected of containing said antibody may be performed as follows:

a) obtaining a biological sample from a patient;

b) incubating one or more *Streptococcus* polypeptides of the invention or fragments thereof with the biological sample to form a mixture; and c) detecting specifically bound antigen or bound fragment in the mixture which indicates the presence of antibody specific to *streptococcus*.

One of skill in the art will recognize that this diagnostic test may take several forms, including an immunological test such as an enzyme-linked immunosorbent assay (ELISA), a radioimmunoassay or a latex agglutination assay, essentially to determine whether antibodies specific for the polypeptide are present in an organism.

The DNA sequences encoding polypeptides of the invention may also be used to design DNA probes for use in detecting the presence of *streptococcus* in a biological sample suspected of containing such bacteria. The detection method of this invention comprises:

a) obtaining the biological sample from a patient;

b) incubating one or more DNA probes having a DNA sequence encoding a polypeptide of the invention or fragments thereof with the biological sample to form a mixture; and c) detecting specifically bound DNA probe in the mixture which indicates the presence of *streptococcus* bacteria.

The DNA probes of this invention may also be used for detecting circulating *Streptococcus* i.e. *S. pneumoniae* nucleic acids in a sample, for example using a polymerase chain reaction, as a method of diagnosing *streptococcus* infections. The probe may be synthesized using conventional techniques and may be immobilized on a solid phase, or may be labelled with a detectable label. A preferred DNA probe for this application is an oligomer having a sequence complementary to at least about 6 contiguous nucleotides of the *streptococcus pneumoniae* polypeptides of the invention.

Another diagnostic method for the detection of *streptococcus* in a patient comprises:

a) labelling an antibody reactive with a polypeptide of the invention or fragment thereof with a detectable label;

b) administering the labelled antibody or labelled fragment to the patient; and c) detecting specifically bound labelled antibody or labelled fragment in the patient which indicates the presence of *streptococcus*.

A further aspect of the invention is the use of the *Streptococcus* polypeptides of the invention as immunogens for the production of specific antibodies for the diagnosis and in particular the treatment of *Streptococcus* infection.

Suitable antibodies may be determined using appropriate screening methods, for example by measuring the ability of a particular antibody to passively protect against *streptococcus* infection in a test model. One example of an animal model is the mouse model described in the examples herein. The antibody may be a whole antibody or an antigen-binding fragment thereof and may belong to any immunoglobulin class. The antibody or fragment may be of animal origin, specifically of mammalian origin and more specifically of murine, rat or human origin. It may be a natural antibody or a fragment thereof, or if desired, a recombinant antibody or antibody fragment. The term recombinant antibody or antibody fragment means antibody or antibody fragment which was produced using molecular biology techniques. The antibody or antibody fragments may be polyclonal, or preferably monoclonal. It may be specific for a number of epitopes associated with the *Streptococcus pneumoniae* polypeptides but is preferably specific for one.

A further aspect of the invention is the use of the antibodies directed to the *streptococcus* polypeptides of the invention for passive immunization. One could use the antibodies described in the present application.

The use of a polynucleotide of the invention in genetic immunization will preferably employ a suitable delivery method or system such as direct injection of plasmid DNA into muscles [Wolf et al. H M G (1992) 1: 363; Turnes et al., Vaccine (1999), 17: 2089; Le et al., Vaccine (2000) 18: 1893; Alves et al., Vaccine (2001) 19: 788], injection of plasmid DNA with or without adjuvants [Ulmer et al., Vaccine (1999) 18: 18; MacLaughlin et al., J. Control Release (1998) 56: 259; Hartikka et al., Gene Ther. (2000) 7: 1171-82; Benvenisty and Reshef, PNAS USA (1986) 83:9551; Singh et al., PNAS USA (2000) 97: 811], targeting cells by delivery of DNA complexed with specific carriers [Wa et al., J Biol Chem (1989) 264: 16985; Chaplin et al., Infect. Immun. (1999) 67: 6434], injection of plasmid complexed or encapsulated in various forms of liposomes [Ishii et al., AIDS Research and Human Retroviruses (1997) 13: 142; Perrie et al., Vaccine (2001) 19: 3301], administration of DNA with different methods of bombardment [Tang et al., Nature (1992) 356: 152; Eisenbraun et al., DNA Cell Biol (1993) 12: 791; Chen et al., Vaccine (2001) 19: 2908], and administration of DNA with lived vectors [Tubulekas et al., Gene (1997) 190: 191; Pushko et al., Virology (1997) 239: 389; Spreng et al. FEMS (2000) 27: 299; Dietrich et al., Vaccine (2001) 19: 2506].

According to one aspect, the present invention provides the use of an antibody for prophylaxis and/or treatment of *streptococcus* infections.

According to one aspect, the present invention provides the use of the pharmaceutical composition of the invention for the prophylactic or therapeutic treatment of Streptococcal infection in an animal susceptible to or infected with streptococcal infection comprising administering to said animal a prophylactic or therapeutic amount of the composition.

In a further embodiment, the invention provides the use of a pharmaceutical composition of the invention in the manufacture of a medicament for the prophylactic or therapeutic treatment of *streptococcus* infection.

In a further embodiment, the invention provides a kit comprising a polypeptide of the invention for detection or diagnosis of *streptococcus* infection.

Unless otherwise defined, all technical and scientific terms used herein have the same meaning as commonly understood by one of ordinary skill in the art to which this invention belongs. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLE 1

This example describes the bacterial strains, plasmids, PCR primers, recombinant proteins and hybridoma antibodies used herein.

*S. pneumoniae* SP64 (serogroup 6) and SP63 (serogroup 9) clinical isolates were provided by the Laboratoire de la Santé Publique du Québec, Sainte-Anne-de-Bellevue; Rx1 strain, a nonencapsulated derivative of the type 2 strain D39 and the type 3 strain WU2 were provided by David E. Briles from University of Alabama, Birmingham and the type 3 clinical isolate P4241 was provided by the Centre de Recherche en Infectiologie du Centre Hospitalier de l'Université Laval, Sainte-Foy. *E. coli* strains DH5α (Gibco BRL, Gaithesburg, Md.); AD494 (λDE3) (Novagen, Madison, Wis.) and BL21 (λDE3) (Novagen) as well as plasmid superlinker pSL301 vector (Invitrogen, San Diego, Calif.); pCMV-GH vector (gift from Dr. Stephen A. Johnston, Department for Biochemistry, University of Texas, Dallas, Tex.); pET32 and pET21 (Novagen) and pURV22.HIS expression vectors (FIG. 30) were used in this study. The pURV22.HIS vector contains a cassette of the bacteriophage λ cI857 temperature-sensitive repressor gene from which the functional $P_R$ promoter has been deleted. The inactivation of the cI857 repressor by a temperature increase from the range of 30-37° C. to 37-42° C. results in the induction of the gene under the control of promoter λPL. The PCR primers used for the generation of the recombinant plasmids had a restriction endonuclease site at the 5' end, thereby allowing directional cloning of the amplified product into the digested plasmid vector.

Molecular biology techniques were performed according to standard methods. See for example, Sambrook, J., Fritsch, E. F., Maniatis, T., "Molecular cloning. A laboratory manual" Vol.1-2-3 (second edition) Cold Spring Harbour Laboratory Press, 1989, New York, which is herein incorporated by reference. PCR-amplified products were digested with restriction endonucleases and ligated to either linearized plasmid pSL301, pCMV-GH, pET or pURV22.HIS expression vector digested likewise or digested with enzymes that produce compatible cohesive ends. Recombinant pSL301 and recombinant pCMV-GH plasmids were digested with restriction enzymes for the in-frame cloning in pET expression vector. When pET vectors were used, clones were first stabilized in *E. coli* DH5α before introduction into *E. coli* BL21(λDE3) or AD494 (λDE3) for expression of full-length or truncated BVH-3 (SEQ ID NO:7), BVH-11 (SEQ ID NO:8) or BVH-11-2 (SEQ ID NO:9) molecules. Each of the resultant plasmid constructs was confirmed by nucleotide sequence analysis. The recombinant proteins were expressed as N-terminal fusions with the thioredoxin and His-tag (pET32 expression system); as C-terminal fusions with an His-tag (pET21 expression system); or as N-terminal fusions with an His-tag (pURV22.HIS expression system). The expressed recombinant proteins were purified from supernatant fractions obtained after centrifugation of sonicated IPTG- (pET systems) or heat- (pURV22.HIS) induced *E. coli* using a His-Bind metal chelation resin (QIAgen, Chatsworth, Calif.). The gene products generated from *S. pneumoniae* SP64 are listed in the following Table 1. The gene fragment encoding BVH-3-Sp63 protein was generated from *S. pneumoniae* SP63 using the PCR-primer sets OCRR479-OCRR480 and the cloning vector pSL301. The recombinant pSL301-BVH-3Sp63 was digested for the in-frame cloning in pET32 vector for the expression of the BVH-3-Sp63 molecule.

TABLE 1

Lists of truncated BVH-3, BVH-11, BVH-11-2 and Chimeric gene products generated from *S. pneumoniae* SP64

| Protein designation | Identification | Encoded amino acids (SEQ ID No 7, 8 or 9) | Cloning vector | SEQ ID NO: |
|---|---|---|---|---|
| BVH-3M | BVH-3 w/o ss | 21-1039 | pSL301 | 14 |
| BVH-3AD | BVH-3 N'end w/o ss | 21-509 | pSL301 | 15 |
| L-BVH-3AD | BVH-3 N'end | 1-509 | pET-21(+) | 16 |
| BVH-3B | BVH-3 C'end | 512-1039 | pSL301 | 17 |
| BVH-3C | BVH-3 N'end w/o ss | 21-225 | pET-32c(+) | 18 |
| BVH-11M | BVH-11 w/o ss | 20-840 | pCMV-GH | 19 |
| BVH-11A | BVH-11 N'end w/o ss | 20-353 | pET-32c(+) | 20 |
| BVH-11B | BVH-11 C'end | 354-840 | pET-32a(+) | 21 |
| BVH-11C | BVH-11 C'end | 228-840 | pET-32a(+) | 22 |
| NEW1 | BVH-3 C'end | 472-1039 | pET-21b(+) | 23 |
| NEW2 | BVH-3 C'end | 472-800 | pET-21b(+) | 24 |
| NEW3 | BVH-3 C'end | 800-1039 | pET-21b(+) | 25 |
| NEW4 | BVH-11 C'end | 286-840 | pET-21d(+) | 26 |
| NEW5 | BVH-11 internal | 286-713 | pET-21d(+) | 27 |
| NEW6 | BVH-11 internal | 672-792 | pET-21d(+) | 28 |
| NEW7 | BVH-11 C'end | 709-840 | pET-21d(+) | 29 |
| NEW8 | BVH-11 internal | 286-511 | pET-21d(+) | 30 |
| NEW9 | BVH-11 internal | 511-713 | pET-21d(+) | 31 |
| BVH-11-2M | BVH-11-2 w/o ss | 20-838 | pSL301 | 32 |
| NEW10 | BVH-11-2 C'end | 271-838 | pET-21d(+) | 33 |
| NEW11 | BVH-11-2 C'end | 699-838 | pET-21d(+) | 34 |
| NEW13 | BVH-11 C'end | 354-840 | pET-21b(+) | 35 |
| NEW14 | BVH-11-2 internal | 227-699 | pET-21d(+) | 36 |
| NEW15 | BVH-3 N'end w/o ss | 21-800 | pET-21b(+) | 37 |
| NEW16 | BVH-11 N'end w/o ss | 20-709 | pET-21d(+) | 38 |
| NEW18 | BVH-11-2 internal | 227-520 | pET21d(+) | 39 |
| NEW19 | BVH-11-2 C'end | 497-838 | pET21d(+) | 40 |
| NEW21 | BVH-3 C'end | 396-1039 | pET21b(+) | 41 |
| NEW22 | BVH-3 internal | 233-446 | pET-21a(+) | 42 |
| NEW23 | BVH-3 internal | 398-509 | pET-21b(+) | 43 |
| NEW24 | BVH-11-2 C'end | 227-838 | pET-21d(+) | 44 |
| NEW25 | BVH-3 C'end | 233-1039 | pET-21b(+) | 45 |
| NEW12 | Chimera* | M- NEW 1 -KL - NEW 13 | pET 21b(+) | 46 |
| NEW17 | Chimera* | M- NEW 5 -GP - NEW 1 | pET 21d(+) | 47 |
| NEW20 | Chimera* | M- NEW 1 -GP - NEW 5 | pET 21d(+) | 48 |
| NEW26 | Chimera* | M- NEW 10 -GP - NEW 25 | pET 21d(+) | 49 |
| NEW27 | Chimera* | M- NEW 19 -GP - NEW 25 | pET 21d(+) | 50 |
| NEW28 | Chimera* | M- NEW 10 -GP - NEW 1 | pET 21d(+) | 51 |
| NEW29 | Chimera* | M- NEW 5 -GP - NEW 25 | pET 21d(+) | 52 |
| NEW30 | Chimera* | M- NEW 4 -GP - NEW 25 | pET 21d(+) | 53 |
| NEW31 | Chimera* | M- NEW 4 -GP - NEW 1 | pET 21d(+) | 54 |
| NEW32 | Chimera* | M- NEW 19 -GP - NEW 1 | pET 21d(+) | 55 | w/o ss: without signal sequence. Analysis of the BVH-3, BVH-11 and BVH-11-2 protein sequences suggested the presence of putative hydrophobic leader sequences.
*encoded amino acids for the chimeras are expressed as the gene product, additional non essential amino acids residue were added
M is methionine,
K is lysine,
L is leucine,
G is glycine and
P is proline.

Monoclonal antibody (Mab)-secreting hybridomas were obtained by fusions of spleen cells from immunized mice and non-secreting, HGPRT-deficient mouse myeloma SP2/0 cells by the methods of Fazekas De St-Groth and Scheidegger (J Immunol Methods 35: 1-21, 1980) with modifications (J. Hamel et al. J Med Microbiol 23 163-170, 1987). Female BALB/c mice (Charles River, St-Constant, Quebec, Canada) were immunized with either BVH-3M (thioredoxin-His•Tag-BVH-3M fusion protein/pET32 system), BVH-11M (thioredoxin-His•Tag-BVH-11M fusion protein/pET32 system), BVH-11-2M (thioredoxin-His•Tag-BVH-11-2M fusion protein/pET32 system), BVH-11B (thioredoxin-His•Tag-BVH-11B fusion protein/pET32 system), BVH-3M (His•Tag-BVH-3 fusion protein/pURV22.HIS system) or NEW1 (NEW1-His•Tag fusion protein/pET21 system) gene products from S. pneumoniae strain SP64 to generate the Mab series H3-, H11-, H112-, H11B-, H3V-, and HN1-, respectively. Culture supernatants of hybridomas were initially screened by enzyme-linked-immunoassay (ELISA) according to the procedure described by Hamel et al. (Supra) using plates coated with preparations of purified recombinant BVH-3, BVH-11 and/or BVH-11-2 proteins or suspensions of heat-killed S. pneumoniae cells. The class and subclass of Mab immunoglobulins were determined by ELISA using commercially available reagents (Southern Biotechnology Associates, Birmingham, Ala.).

Furthermore, the cloning and expression of chimeric gene(s) encoding for chimeric polypeptides and the protection observed after vaccination with these chimeric polypeptides are described.

BVH-3 and BVH-11 gene fragments corresponding to the 3' end of the genes were amplified by PCR using pairs of oligonucleotides engineered to amplify gene fragments to be included in the chimeric genes. The primers used had a restriction endonuclease site at the 5' end, thereby allowing directional in-frame cloning of the amplified product into digested plasmid vectors. PCR-amplified products were digested with restriction endonucleases and ligated to linearized plasmid pET21 or pSL301 vector. The resultant plasmid constructs were confirmed by nucleotide sequence analysis. The recombinant pET21 plasmids containing a PCR product were linearized by digestion with restriction enzymes for the in-frame cloning of a second DNA fragment and the generation of a chimeric gene encoding for a chimeric pneumococcal protein molecule. Recombinant pSL301 plasmids containing a PCR product were digested with restriction enzymes for the obtention of the DNA inserts. The resulting insert DNA fragments were purified and inserts corresponding to a given chimeric gene were ligated into pET21 vector for the generation of a chimeric gene. The recombinant chimeric polypeptides were as C-terminal fusion with an His-tag. The expressed recombinant proteins were purified from supernatant fractions obtained from centrifugation of sonicated IPTG-induced E. coli cultures using a His-Bind metal chelation resin (QIAgen, Chatsworth, Calif.).

Groups of 8 female BALB/c mice (Charles River) were immunized subcutaneously two times at three-week intervals with 25 µg of either affinity purified His•Tag-fusion protein identifed in presence of 15-20 µg of QuilA adjuvant. Ten to 14 days following the last immunization, the mice were challenged challenged intravenously with 10E5-10E6 CFU of S. pneumoniae type 3 strain WU2.

EXAMPLE 2

This example describes the identification of peptide domains carrying target epitopes using Mabs and recombinant truncated polypeptides described in example 1.

Hybridomas were tested by ELISA against truncated BVH-3, BVH-11 or BVH-11-2 gene products in order to characterize the epitopes recognized by the Mabs. The truncated gene products were generated from S. pneumoniae SP64 strain except for BVH-3-Sp63 which was generated from S. pneumoniae SP63 strain. As a positive control, the reactivity of each antibody was examined with full-length BVH-3, BVH-11 or BVH-11-2 recombinant proteins. In some cases, the Mab reactivity was evaluated by Western immunoblotting after separation of the gene product by SDS-PAGE and transfer on nitrocellulose paper.

BVH-3-reactive Mabs can be divided into two groups BVH-3A- and BVH-3B-reactive Mabs with the exception of Mabs H11-7G11 and H3V-15A10 which reacted with both, BVH-3A and BVH-3B molecules. The BVH-3A-reactive Mabs can be subdivided in two subgroups of antibodies depending of their reactivity or lack of reactivity with BVH-3C recombinant protein. Mab reactive with BVH-3C protein recognized epitopes shared by both, BVH-3 and BVH-11 proteins. These BVH-3- and BVH-11-cross-reactive Mabs were also reactive with BVH-11A and BVH-11-2M recombinant proteins. BVH-3B-reactive Mabs can be subdivided into three subgroups according to their reactivity with NEW1, NEW2 and NEW3 recombinant proteins. Some Mabs were only reactive with the NEW1 protein while other Mabs were reactive with either, NEW1 and NEW2 or NEW1 and NEW3 recombinant proteins.

Mabs H11-7G11 and H3V-15A10 react with epitopes in more than one position on BVH-3. The reactivity of H11-7G11 with BVH-3AD, BVH-3B, BVH-3C, BVH-11A and BVH-11-2M molecules suggests that H11-7G11 epitope might comprised HXXHXH sequence. This sequence is repeated, respectively, 6 and 5 times in BVH-3 (see SEQ ID NO: 159) and BVH-11/BVH-11-2 protein sequences. The lack of reactivity of Mab H11-7G11 with NEW 10 molecule suggests that the epitope includes the HGDHXH sequence (see SEQ ID NO: 160). Multiple-position mapping of H3V-15A10 epitope on BVH-3 is suggested by the reactivity of the Mab with two BVH-3 fragments that do not overlap.

Interestingly, Mabs H3-7G2, H3V-9C6 and H3V-16A7 were not reactive with BVH-3 Sp63 thus allowing the location of their corresponding epitopes on a 177-amino acid fragment comprised between amino acids 244 and 420 on BVH-3 molecule of S. pneumoniae SP64.

The Mabs that are reactive with BVH-11- and/or BVH-11-2 and that do not recognize BVH-3 molecules can be divided into three groups according to their reactivities with BVH-11A and NEW10 recombinant proteins. Some Mabs reacted exclusively with either BVH-11A or NEW10 protein while other Mabs were reactive with both, BVH-11A and NEW10 recombinant proteins.

Furthermore, the peptide sequences obtained from the screening of BVH-3 and BVH-11-2 gene libraries with the Mabs are in agreement with the Mab ELISA reactivities against the truncated gene products. As expected, the amino acid sequences obtained from H11-7G11 contained the sequence HGDHXH (SEQ ID NO: 160). These findings provide additional evidence for the location of epitopes recognized with the Mabs. Interestingly, although the Mabs H112-10G9, H112-10A2 and H11B-11B8 were reactive against the same peptide sequence (amino acid residues 594 to 679 on BVH-11-2 protein sequence), clones corresponding to the sequence spanning from amino acid residues 658 to 698 were only picked up by Mab H11B-11B8 thus revealing the location of H11B-11B8 epitope between amino acid residues 658 to 679. Mabs H112-10G9, H112-10A2, and H11B-11B8 are directed against 3 distinct non overlapping epitopes located closely on the peptide sequence corresponding to amino acid residues 594 to 679.

EXAMPLE 3

This example describes truncated variant BVH-3 gene products generated from *S. pneumoniae* SP64

Further BVH-3 fragments or variants thereof were designed in the purpose to develop a universal highly effective vaccine that would target the immune response to ubiquitous surface-exposed protective epitopes. BVH-3 gene fragments designated NEW1 (encoding amino acid residues 472 to 1039 from SEQ ID NO: 7) and NEW40 (encoding amino acid residues 408 to 1039 from SEQ ID NO: 7) were amplified from the *S. pneumoniae* strain SP64 by PCR using pairs of oligonucleotides engineered for the amplification of the appropriate gene fragment.

EXAMPLE 4

This example describes NEW43 variant gene products generated from *S. pneumoniae* SP64.

Four BVH-11-2 gene segments were fused together to generate New43 gene and protein molecule. Restriction enzymes SpeI, SacII and KpnI allowed the directional in-frame cloning of the fragments. In a series of New43-related molecules (see in Table 4, New133, New134, New135, New139, New139Y, New142, New143 and New144), mutagenesis steps were performed to modify the pairs of codons created by the addition of the resctriction sites at each junction site of the four BVH-11-2 regions. Variants from NEW43 (SEQ ID NO: 11) were generated by mutagenesis using the Quickchange Site-Directed Mutagenesis kit from Stratagene and the oligonucleotides designed to incorporate the appropriate mutation. The presence of 6 histidine tag residues on the C-terminus of the recombinant molecules simplified the purification of the proteins by nickel chromatography. The following table 3 describes the NEW43 variant gene products generated.

TABLE 2

List of truncated variant BVH-3 gene products generated from *S. pneumoniae* SP64

| Protein designation | Gene/Protein SEQ ID NO | Protein Identification* | |
|---|---|---|---|
| NEW1-mut1** | 56 | NEW1 | |
| NEW35A | 57 | NEW1 | 550-<u>S</u>GD<u>GT</u>S-555 |
| NEW42 | 58 | NEW40 | 55-<u>S</u>GD<u>SN</u>S-60    144-<u>S</u>GD<u>GT</u>S-149 |
| NEW49 | 59 | NEW40 | 55-<u>S</u>GDHNH-60 |
| NEW50 | 60 | NEW40 | 55-<u>S</u>GD<u>S</u>NH-60 |
| NEW51 | 61 | NEW40 | 55-<u>S</u>GDHNH-60    144-<u>S</u>GDHHH-149 |
| NEW52 | 62 | NEW40 | 55-<u>S</u>GD<u>S</u>NH-60    144-<u>S</u>GD<u>G</u>HH-149 |
| NEW53 | 63 | NEW40 | 55-HGDHNH-60    144-<u>S</u>GDHHH-149 |
| NEW54 | 64 | NEW40 | 55-HGDHNH-60    144-<u>S</u>GD<u>G</u>HH-149 |
| NEW55 | 65 | NEW1 | 550-HGD<u>G</u>HH-555 |
| NEW56 | 66 | NEW40 | 55-HGD<u>S</u>NH-60    144-<u>S</u>GDHHH-149 |
| NEW56-mut2** | 67 | NEW56 | |
| NEW56-mut3** | 68 | NEW56 | |
| NEW57 | 69 | NEW40 | 55-HGDHN<u>S</u>-60    144-<u>S</u>GDHHH-149 |
| NEW63 | 70 | NEW40 | 55-HGD<u>S</u>NH-60    144-HGDHHH-149 |
| NEW64 | 71 | NEW40 | 55-HGDHN<u>S</u>-60    144-HGDHHH-149 |
| NEW65 | 72 | NEW40 | 55-HGD<u>S</u>NH-60    144-HGD<u>G</u>HH-149 |
| NEW66 | 73 | NEW40 | 55-HGDHN<u>S</u>-60    144-HGD<u>G</u>HH-149 |
| NEW76 | 74 | NEW40 | 55-HGDHN<u>S</u>-60    144-<u>S</u>GD<u>G</u>HH-149 |
| NEW105 | 75 | NEW40 | 55-_____-60 |
| NEW106 | 76 | New40 | 144-_____-149 |
| NEW107 | 77 | NEW40 | 55-_____-60    144-_____-149 |

*The underlined amino acid residues represent the modification in protein sequence. Nucleotides/amino acid residues are deleted in NEW105, NEW106 and NEW107 constructs.
**silent mutation, i.e. the polypeptide is the same as New1 or New56.

TABLE 3

List of NEW43 variant gene products generated from *S. pneumoniae* SPG4

| Polypeptide designation | Polypeptide SEQ ID NO | Polypeptide identification* | PCR primer set | Gene used for mutagenesis |
|---|---|---|---|---|
| NEW60 | 78 | NEW43 109-SYDHYH-114 | 1 | NEW43 |
| NEW61 | 79 | NEW43 109-HYDSYH-114 | 26 | NEW43 |
| NEW62 | 80 | NEW43 109-HYDHYS-114 | 27 | NEW43 |
| NEW80 | 81 | NEW43 109-SYDSYH-114 | 2 | NEW60 |
| NEW81 | 82 | NEW43 109-SYDSYS-114 | 3 | NEW80 |
| NEW82 | 83 | NEW43 109-HYDSYS-114 | 29 | NEW61 |
| NEW83 | 84 | NEW43 109-SYDHYS-114 | 30 | NEW60 |
| NEW84 | 85 | NEW43 109-SKDHYH-114 | 31 | NEW60 |
| NEW85 | 86 | NEW43 109-HKDSYH-114 | 32 | NEW61 |
| NEW88D1 | 87 | NEW43 109-__DHYH-114 | 33 | NEW43 |
| NEW88D2 | 88 | NEW43 109-____YH-114 | 34 | NEW88D1 |
| NEW88 | 89 | NEW43 109-______-114 | 35 | NEW88D2 |

*The underlined amino acid residues represent the modification in protein sequence. Nucleotides/amino acid residues are deleted in NEW88D1, NEW88D2 and NEW88 constructs.

EXAMPLE 5

This example describes the cloning and expression of chimeric gene(s) encoding for chimeric polypeptides.

BVH-3 and BVH-11 gene fragments corresponding to the 3' end of the genes were amplified by PCR using pairs of oligonucleotides engineered to amplify gene fragments to be included in the chimeric genes. The primers used had a restriction endonuclease site at the 5' end, thereby allowing directional in-frame cloning of the amplified product into digested plasmid vectors. PCR-amplified products were digested with restriction endonucleases and ligated to linearized plasmid pET21 or pSL301 vector. The resultant plasmid constructs were confirmed by nucleotide sequence analysis. The recombinant pET21 plasmids containing a PCR product were linearized by digestion with restriction enzymes for the in-frame cloning of a second DNA fragment and the generation of a chimeric gene encoding for a chimeric pneumococcal protein molecule. Recombinant pSL301 plasmids containing a PCR product were digested with restriction enzymes for the obtention of the DNA inserts. The resulting insert DNA fragments were purified and inserts corresponding to a given chimeric gene were ligated into pET21 vector for the generation of a chimeric gene. The recombinant chimeric polypeptides listed in Table 4 were as C-terminal fusion with an His-tag. The expressed recombinant proteins were purified from supernatant fractions obtained from centrifugation of sonicated IPTG-induced *E. coli* cultures using a His-Bind metal chelation resin (QIAgen, Chatsworth, Calif.).

TABLE 4

Chimera constructions

| Chimeras with BVH-11 and BVH-3 | Polypeptide SEQ | SEQ ID NO |
|---|---|---|
| New 108 | M*-New56-G*P*-New88 | 90 |
| New 109 | M*-New88-G*P*-NEW56 | 91 |
| New 133 | New 43 Spe1 ⇒ GG | 92 |
| New 134 | New 43 Kpn1 ⇒ GG | 93 |
| New 135 | New 43 Spe1, SacII, Kpn1 ⇒ GG | 94 |
| New 136 | New 43 109-HHDHYH-114 | 1 |
| New 136Y | New 43 109-HHDHYY-114 | 95 |

TABLE 4-continued

Chimera constructions

| Chimeras with BVH-11 and BVH-3 | Polypeptide SEQ | SEQ ID NO |
|---|---|---|
| New 136Y1 | New 43 109-YHDHYY-114 | 96 |
| New 137 | New 43 109-HYDHHH-114 | 97 |
| New 138 | New 43 109-HHDHHH-114 | 98 |
| New 139 | New 136 Spe1, SacII, Kpn1 ⇒ GG | 2 |
| New 139Y | New 136Y Spe1, SacII, Kpn1 ⇒ GG | 99 |
| New 142 | New 88 Spe1 ⇒ GG | 100 |
| New 143 | New 88 Kpn1 ⇒ GG | 101 |
| New 144 | New 88 Spe1, SacII, Kpn1 ⇒ GG | 102 |
| New 145 | New88-GG-New56 | 103 |
| New 146 | New144-GG-New 56 | 104 |
| New 147 | New139-GG-New56 | 3 |
| New 148 | New140-GG-New56 | 105 |
| New 149 | New141-GG-New56 | 106 |
| New 150 | New139Y-GG-New56 | 107 |
| New 150 A | M*-New136-G*P*-New56 | 108 |
| New 150 B | M*-New136-G*G*-New56 | 109 |
| New 150 C | M*-VP56-G*P*-New136 | 110 |
| New 150 D | M*-VP56-G*G*-New136 | 111 |
| New 150 E | M*-VP56-G*P*-New139 | 112 |
| New 150 F | M*-VP56-G*G*-New139 | 113 |
| New 150 G | M*-New139-G*G*-VP56 | 114 |
| New 150 H | M*-New139-G*P*-VP56 | 115 |

*OPTIONAL AMINO ACID
M: met;
G: gly;
P: pro

EXAMPLE 6

This example describes an ELISA reactivity experiment made with protective Mab:

The reactivity of the molecules was evaluated by ELISA using a panel of monoclonal antibodies (Mabs) raised against BVH-11-2 (Mabs H112-10A2, H112-14H6, H112-10G9, H112-10C5, H56-10B11, H112-4G9, H11B-11B8, H11B-13D5). The results are presented in Table 5 and Table 6 (Example 7). The improvement in the reactivity of Mab-epitopes was demonstrated by the significant increase in Elisa signals of some Mabs with New136, New139 and New147 in comparison to those obtained with New43 antigen.

TABLE 5

Elisa reactivity with protective Mab

| Molecules (SEQ ID No) | H112-10G9 | H112-10A2 | H11B-11B8 | H56-10B11 |
|---|---|---|---|---|
| New 43 (HYDHYD) (11) | 2+ | 4+ | 2+ | 4+ |
| New 88 (_____) (89) → to be inserted in VP109 | 2+ | 1+ | 0 | 0 |
| New 136 (HHDHYH) (95) | 4+ | 4+ | 4+ | 4+ |
| NEW 139 (HHDHYH)-GG (100) → to be inserted in VP147 | 4+ | 4+ | 4+ | 4+ |
| NEW 147 (HHDHYH)-GG (107) | 4+ | 4+ | 4+ | 4+ |

EXAMPLE 7

The reactivity of the New43-derived molecules was evaluated by ELISA using a panel of monoclonal antibodies (Mabs) raised against BVH-11-2 (Mabs H112-10A2, H112-14H6, H112-10G9, H112-10C5, H56-10B11, H112-4G9, H11B-11B8, H11B-13D5) antigens and mouse or monkey sera.

EXAMPLE 8

This example illustrates that immunization with chimeric vaccine VP147 generates protective immunity against lethal experimental pneumococcal disease.

Previous studies have clearly established that pneumococcal BVH-3 and BVH-11-2 proteins were simultaneously expressed at the surface of the bacteria and elicited protec-

TABLE 6

Antigenic properties of New43-derived molecules in ELISA

| New43-derived molecules (SEQ ID No) | Polypeptide sequence | H112-10G9 | H112-10A2 | H11B-11B8 | H56-10B11 | Mouse anti-New 41 Sp 327 TB2 Gr D Diluted 1/10000 | Monkey anti-New 19 Sp 335 5066CQ TB3a 1/12500 | Monkey anti-New 19 Sp 335 C93072F TB3a 1/12500 | Monkey anti-New 43 Sp 335 C93005F TB3a 1/12500 |
|---|---|---|---|---|---|---|---|---|---|
| New 43 (11) | BVH11-2 internal chimeric 109- HYDHYH-114 with internal sites Spe1-SacII-Kpn1 | 1.570 | 3.960 | 0.702 | 1.118 | 3.036 | 0.912 | 0.678 | 1.417 |
| New 60 (78) | New 43 109- SYDHYH-114 | | | | | 2.740 | 0.647 | 0.432 | 0.856 |
| New 133 (92) | New 43 Spe1 ⇒ GG | | | | | 3.196 | 0.910 | 0.692 | 1.396 |
| New 134 (93) | New 43 Kpn1 ⇒ GG | | | | | 3.107 | 0.947 | 0.698 | 1.379 |
| New 135 (94) | New 43 Spe1, SacII, Kpn1 ⇒ GG | | | | | 3.294 | 0.968 | 0.669 | 1.368 |
| New 136 (1) | New 43 109- HHDHYH-114 | 1.518 | 3.944 | 1.566 | 1.231 | 3.333 | 1.029 | 0.713 | 1.201 |
| New 136Y (95) | New 43 109- HHDHYY-114 | | | | | 3.316 | 0.888 | 0.562 | 0.712 |
| New 136Y1 (96) | New 43 109- YHDHYY-114 | | | | | 2.847 | 0.696 | 0.433 | 0.618 |
| New 137 (97) | New 43 109- HYDHHH-114 | | | | | 3.121 | 1.028 | 0.733 | 1.422 |
| New 138 (98) | New 43 109- HHDHHH-114 | | | | | 2.955 | 1.058 | 0.701 | 0.982 |
| New 139 (2) | New 136 Spe1, SacII, Kpn1 ⇒ GG | 1.564 | 3.915 | 1.790 | 1.089 | 3.167 | 1.022 | 0.684 | 0.984 |
| New 139Y (99) | New 136Y Spe1, Sac11, Kpn1 ⇒ GG | | | | | 3.070 | 0.728 | 0.452 | 0.599 |
| New 86 (149) | New 43 HHH Sma1 | | | | | 2.664 | 0.633 | 0.383 | 0.604 |
| New 88 (89) | New 43 HHH deletion | 0.755 | 3.960 | 0.062 | 0.057 | 1.975 | 0.549 | 0.423 | 0.551 |
| New 142 (100) | New 88 Spe1 ⇒ GG | | | | | 2.049 | 0.757 | 0.586 | 0.804 |
| New 143 (101) | New 88 Kpn1 ⇒ GG | | | | | 2.044 | 0.629 | 0.444 | 0.621 |
| New 144 (102) | New 88 Spe1, SacII, Kpn1 ⇒ GG | | | | | 2.280 | 0.638 | 0.440 | 0.613 |
| VP 109 (91) | New88-GP-New 56 | 1.570 | 3.960 | 0.057 | 0.064 | 2.554 | 0.773 | 0.351 | 0.593 |
| New 145 (103) | New88-GG-New56 | 1.064 | 3.958 | 0.058 | 0.088 | 2.770 | 0.863 | 0.444 | 0.693 |
| New 146 (104) | New144-GG-New 56 | 1.162 | 3.691 | 0.065 | 0.072 | | | | |
| New 56 (12) | New 40 (472-1039) HSH SHHH | 0.052 | 0.075 | 0.055 | 0.067 | 0.169 | 0.276 | 0.396 | 0.173 |
| New 90 (150) | New43-GP-New56 | | | | | 3.838 | 1.594 | 1.122 | 2.113 |
| New 147 (3) | New139-GG-New56 | 1.950 | 3.960 | 2.132 | 1.394 | 3.820 | 1.507 | 0.865 | 1.490 |
| New 148 (105) | New140-GG-New56 | | | | | | | | |
| New 149 (106) | New141-GG-New56 | 1.993 | 3.959 | 0.878 | 1.795 | | | | |
| New 150 (107) | New139Y-GG-New56 | | | | | | | | | tive immune responses when used as immunogens. To generate the VP147 vaccine molecule, the DNA region corresponding to the conserved surface exposed protective region from BVH-3 (called VP56) was fused in-frame at the 5' end with four conserved gene regions from BVH-11-2 (called VP139; SEQ ID NO:2)(FIG. 5). The chimeric VP147 molecule was made from one BVH-3 and four BVH-11-2 fragments linked at junction sites by pairs of glycine residues which are known to facilitate movement (gene and protein sequences correspond to SEQ ID NO:3 and 4, respectively).

Groups of 8 female BALB/c mice (Charles River, St-Constant, Canada) were immunized subcutaneously three times at three-week intervals with 5 to 25 μg of recombinant protein in presence of QuilA (Cedarlane Laboratories Ltd, Hornby, Canada) or Alhydrogel® (AlOH) adjuvant or, as control, with adjuvant alone in PBS. Blood samples were collected from the orbital sinus on day 1, 22 and 43 prior to each immunization and seven days (day 50) following the third injection. Five to seven days later, the mice were challenged with varying CFU numbers (from $10^3$ to $10^5$CFU) of the type 3 *S. pneumoniae* strain P4241 in order to evaluate the protection conferred by vaccination. Samples of the *S. pneumoniae* challenge inoculum were plated on chocolate agar plates to determine the CFU and to verify the challenge dose. Deaths were recorded for a period of 14 days and on day 14 post-challenge, the surviving mice were sacrificed and blood samples tested for the presence of *S. pneumoniae* organisms.

The survival data are shown in Table 7A. In these experiments, all control mice injected with adjuvant alone succumbed to infection while significant protection against deadly infection was observed in mice vaccinated with VP56 or VP139 and other New43 derivative molecules. The significant difference in VP56 and VP147 survival curves (Experiment 4 from Table 7A) indicated that VP147 could generate better immune responses than VP56. Moreover, the higher survival rate observed in experiment 5 (Table 7A) corresponds to mice vaccinated with VP147 with 6 out of 8 survivors thus suggesting that the VP147 protein affords equivalent if not superior protection than a combination of VP56 and VP139. These data indicated that VP147 could be a very useful antigen to prevent pneumococcal disease in humans.

The superiority of VP147 over VP56 was also demonstrated by performing standard immunoassays such as ELISA, Western immunoblotting and flow cytometry using sera from mice immunized with Alhydrogel® or QuilA adjuvanted vaccine formulations. These studies clearly indicated that immunization with recombinant VP147 protein produced in *E. coli* elicited antibodies reactive with recombinant and native pneumococcal BVH-3 and BVH-11-2 protein antigens as opposed to VP56 which generated exclusively BVH-3-reactive antibodies. Flow cytometry studies allowed the detection of the antibodies that bound specifically to surface exposed epitopes on the pneumococcal cells. Because opsonophagocytosis is a major mechanism of protection against pneumococcal infection, the antibodies detected in flow cytometry would likely be the most biologically relevant antibodies. The fluorescence index derived from flow cytometric evaluation of anti-VP147 antibodies was significantly greater to that detected with anti-VP56 antibodies (Table 7B). The binding to both, BVH-3 and BVH-11-2, surface proteins was confirmed in inhibition cytometric studies using VP56, VP139 and VP147 as inhibitors. Preincubation of serum raised to VP147 with soluble VP147 completely blocked the antibody surface labeling while partial inhibition (40 to 74% inhibition) was observed when soluble VP56 or New 139 was used. In contrast, VP56 and VP147 proteins were able to completely eliminate the binding of anti-VP56 antibody with no significant inhibition with New139, as expected. Altogether these results indicate an improvement in surface epitope labeling afforded by antibodies raised to VP147 over those generated to VP56 and support the use of VP147 as vaccine for the protection of humans from pneumococcal disease.

TABLE 7A

Protection mediated by recombinant VP147 in experimental pneumococcal pneumonia.

| Experiment | Immunogen | Alive:Dead | Days to death post-infection | P values[a] |
|---|---|---|---|---|
| 1 | QuilA alone | 0:8 | 4, 5, 5, 5, 6, 6, 6 | — |
| | New 43 | 7:1 | 9, 7 X >14 | <0.0001 |
| | New 135 | 8:0 | 8 X >14 | <0.0001 |
| | New 136 | 8:0 | 8 X >14 | <0.0001 |
| | New 137 | 7:1 | 8, 7 X >14 | <0.0001 |
| | New 138 | 8:0 | 8 X >14 | <0.0001 |
| 2 | QuilA alone | 0:8 | 4, 4, 4, 4, 4, 5, 5, 5 | — |
| | New 135 | 8:0 | 8 X >14 | <0.0001 |
| | New 139 | 6:2 | 5, 6, >14, >14, >14, >14, >14, >14 | 0.0003 |
| | QuilA alone | 0:8 | 4, 4, 4, 4, 4, 5, 5, 5 | — |
| 3 | VP56 | 8:0 | 8 X >14 | <0.0001 |
| | VP147 | 6:2 | 6, 7, >14, >14, >14, >14, >14, >14 | <0.0001 |
| 4 | AlOH alone | 0:8 | 4, 4, 4, 4, 4, 5, 5, 5 | — |
| | VP56 | 1:7 | 5, 5, 5, 5, 5, 5, 6, >14 | 0.012 |
| | VP147 | 4:4 | 5, 6, 7, 9, >14, >14, >14, >14 | 0.0005[b] |
| 5 | AlOH alone | 0:8 | 4, 4, 5, 5, 5, 5, 5, 5 | — |
| | VP56 | 4:3 | 4, 5, 5, >14, >14, >14, >14 | 0.040 |
| | VP139 | 2:6 | 4, 5, 5, 5, 6, 6, >14, >14 | 0.047 |
| | VP56 + VP139 | 4:3 | 5, 5, 5, >14, >14, >14 | 0.011 |
| | VP147 | 6:2 | 6, 7, >14, >14, >14, >14, >14, >14 | 0.008 |

[a]For statistical analysis, P values were calculated using the logrank test to compare the survival curves for immunized mice to controls injected with adjuvant alone.
[b]There was a significant difference (P = 0.031) between VP147 and VP56 survival curves.

TABLE 7B

Comparison of surface antibody labeling obtained
with antibodies raised against VP56 and VP147 formulated to
Alhydrogel or QuilA and percentage inhibition values using
VP56, New 139 and VP147 competitors demonstrating the
specificity of the surface labeling antibody for BVH-3
(VP56) or BVH-11-2 (New139) epitopes.

| Mouse serum | competitor | Fluorescence Index[a] | % inhibition |
|---|---|---|---|
| rVP56-QuilA (mouse 1) | None | 13.47 | |
| | New139 | 13.44 | 0.2 |
| | VP56 | 0.04 | 99.7 |
| | VP147 | 0.07 | 99.5 |
| rVP56-QuilA (mouse 2) | None | 16.90 | |
| | New139 | NA[b] | |
| | VP56 | 0.03 | 99.8 |
| | VP147 | 0.11 | 99.3 |
| rVP147-QuilA (mouse 1) | None | 24.59 | |
| | New139 | 14.43 | 41.3 |
| | VP56 | 7.85 | 68.1 |
| | VP147 | 0.07 | 99.7 |
| rVP147-QuilA (mouse 2) | None | 25.06 | |
| | New139 | 14.86 | 40.7 |
| | VP56 | 6.48 | 74.1 |
| | VP147 | 0.09 | 99.6 |
| rVP56-AlOH (mouse 1) | None | 11.09 | |
| | New139 | 11.15 | 0.0 |
| | VP56 | 0.03 | 99.7 |
| | VP147 | 0.05 | 99.6 |
| rVP56-AlOH (mouse 2) | None | 13.25 | |
| | New139 | 14.55 | 0.0 |
| | VP56 | 0.00 | 100.0 |
| | VP147 | 0.00 | 100.0 |
| rVP147-AlOH (mouse 1) | None | 18.78 | |
| | New139 | 8.67 | 53.8 |
| | VP56 | 9.43 | 50.0 |
| | VP147 | 0.06 | 99.7 |
| rVP147-AlOH (mouse 2) | None | 16.27 | |
| | New139 | 8.18 | 49.7 |
| | VP56 | 6.25 | 61.6 |
| | VP147 | 0.04 | 99.8 |

[a]The background value (Fl = 1.00) obtained with conjugate alone was subtracted from the test values.
[b]NA, not available data

EXAMPLE 9

This example illustrates the generation of chimeric gene products made from BVH-3 and BVH-11-2 fragments linked to each other by peptide linkers.

Replacement in the chimeric VP147 of the glycine residues at the junction sites between the BVH-3 and BVH-11-2 gene fragments resulted in variant forms which could differ in protein production, protein stability, antigenicity, immunogenicity and biological activity such as protective immunity. Here, we report the generation of sequence linkers to modify the fusion sites located at amino acid residues 223-224 and residues 273-274 of the VP147 molecule (SEQ ID NO:3).

Table 8 describes the sequences of the linkers generated during this study. Linkers R1, R2, R3, L2 and L4 were designed based on BVH-3 gene/protein sequence. The R1 linker is composed of BVH-3 amino acid residues 814 to 836, whereas the R2 linker is composed of amino acid residues 468 to 490 of the BVH-3 protein in which the Phe residue in position 468 was substituted for a Gln residue. The R3 linker is composed of BVH-3 amino acid residues 818 to 836. The L2 linker is composed of amino acids 507 to 531 of the BVH-3 protein. In this case, residues 514, 515, 519, 520, 525 and 526 corresponding to Asp, Leu, Ile, Glu, Gly and Ile were substituted for Glu, Ala, Ala, Gln, Glu and Ala, respectively. The L4 linker is composed of BVH-3 amino acids 849 to 859. The L1 and L3 linkers are flexible linkers composed of 26 and 12 amino acid residues, respectively, that show no significant similarity with any known protein present in the available data banks.

TABLE 8

List of the linker polypeptide sequences.

| Linker identification | SEQ ID NO: | Linker peptide sequence |
|---|---|---|
| R1 | 116 | SILPQFKRNKAQENSKLDEKVEE |
| R2 | 117 | QFKKDLTEEQIKAAQKHLEEVKT |
| R3 | 118 | QFKRNKAQENSKLDEKVEE |
| L1 | 119 | GDAAAKEAAAKEAAAKEAAAKEAAAK |
| L2 | 120 | GNAKEMKEADKKAQEKIAEAMKQYG |
| L3 | 121 | GSTNQYGNQTSG |
| L4 | 122 | SETGNSTSNST |

To create variant VP147 molecules modified by insertion of linker sequences at the fusions sites, the DNA sequences encoding for the peptide linkers were inserted in the recombinant pET vector pET21b-new147 by PCR using the primer sets listed in Table 9. Two complementary primers were used for each PCR mutagenesis. Variants of VP147 were generated by mutagenesis using the QuikChange® Site-Directed Mutagenesis Kit (Stratagene, Cedar Creek, Tex.). Clones were first stabilized in E. coli XL1-Blue before introduction into E. coli BL21 (λDE3) for expression of the new chimeric proteins. The presence of a hexahistidine tag at the C-terminus of the recombinant molecules allowed the purification of the proteins by nickel chromatography.

The primers used for the creation of variants VP147-R1, VP147-R2, VP147-R3, VP147-L3 and VP147-L4 were composed of one linker and annealing zones complementary to 30 bp-long regions upstream and downstream of the insertional site, respectively.

The L1 and L2 linkers to create the chimeric VP147-L1 and VP147-L2 proteins were long, and a two-step mutagenesis strategy was preferred to the one-step strategy described above. A first step of mutagenesis incorporated half of the linker sequences. With a second round of mutagenesis, the full-length linkers were incorporated in the constructs. For the first mutagenesis step, primers were composed of the first half of the linker and annealing zones complementary to 30 bp-long regions upstream and downstream of the insertional site, respectively, on each side of the linker sequence. For the second mutagenesis step, primers were composed of the second half of the linker and annealing zones, about 30 bp-long, corresponding to a region in the first half of the linker and a region downstream of the insertional site, respectively, on each side of the added linker sequence. To eliminate the risk of annealing between the linkers composed of a BVH-3 section and the sequence coding for the VP56 portion of VP147, the linker's sequences were degenerated. Table 9 describes sequences of the primers used for the mutagenesis experiments and the corresponding variant gene products, respectively. FIG. 8 shows an alignment of amino acid sequences of VP147 and variants thereof.

TABLE 9

List of PCR oligonucleotide primer sets used to generate VP147 variants.

| Primer set | Primer identification | SEQ ID No: | Primer SEQUENCE |
|---|---|---|---|
| 1 | CHAN262 | 123 | 5'-GAAGATACCACAGATGAGGCTGAAATTCCTTCCATCTTGCCTCAGTTCAAGCGAAACAAAGCTCAGGAGAAT TCCAAACTCGACGAAAAAGTCGAAGAGCCTAGTATTAGACAAAATGCTATGGAGACA-3' |
|   | CHAN263 | 124 | 5'-TGTCTCCATAGCATTTTGTCTAATACTAGGCTCTTCGACTTTTTCGTCGAGTTTGGAATTCTCCTGAGCTTT GTTTCGCTTGAACTGAGGCAAGATGGAAGGAATTTCAGCCTCATCTGTGGTATCTTC-3' |
| 2 | CHAN264 | 125 | 5'-GAAGATACCACAGATGAGGCTGAAATTCCTCAATTCAAGAAAGATCTCACGGAGGAACAGATCAAAGCAGCA CAGAAGCACCTGGAAGAGGTCAAGACCCCTAGTATTAGACAAAATGCTATGGAGACA-3' |
|   | CHAN265 | 126 | 5'-TGTCTCCATAGCATTTTGTCTAATACTAGGGGTCTTGACCTCTTCCAGGTGCTTCTGTGCTGCTTTGATCTG TTCCTCCGTGAGATCTTTCTTGAATTGAGGAATTTCAGCCTCATCTGTGGTATCTTC-3' |
| 3 | CHAN266 | 127 | 5'-GAAGATACCACAGATGAGGCTGAAATTCCTCAATTCAAGCGCAACAAGGCTCAAGAGAATTCCAAGTTGGAC GAGAAAGTCGAGGAACCTAGTATTAGACAAAATGCTATGGAGACA-3' |
|   | CHAN267 | 128 | 5'-TGTCTCCATAGCATTTTGTCTAATACTAGGTTCCTCGACTTTCTCGTCCAACTTGGAATTCTCTTGAGCCTT GTTGCGCTTGAATTGAGGAATTTCAGCCTCATCTGTGGTATCTTC-3' |
| 4 | CHAN260 | 129 | 5'-AAAGAAAGTCAACCGGCTCCTATACAAGGTTCCACCAATCAGTACGGCAATCAAACCTCTGGGCAAATTGGG CAACCGACTCTTCCAAACAAT-3' |
|   | CHAN261 | 130 | 5'-ATTGTTTGGAAGAGTCGGTTGCCCAATTTGCCCAGAGGTTTGATTGCCGTACTGATTGGTGGAACCTTGTAT AGGAGCCGGTTGACTTTCTTT-3' |
| 5 | CHAN248 | 131 | 5'-TTAAAAGAAAGTCAACCGGCTCCTATACAGTCCGAGACAGGTAACTCTACGTCCAACAGCACGCAAATTGGG CAACCGACTCTTCCAAACAAT-3' |
|   | CHAN249 | 132 | 5'-ATTGTTTGGAAGAGTCGGTTGCCCAATTTGCGTGCTGTTGGACGTAGAGTTACCTGTCTCGGACTGTATAGG AGCCGGTTGACTTTCTTTTAA-3' |
| 6 | CHAN277 | 133 | 5'-AAAGAAAGTCAACCGGCTCCTATACAAGGTGACGCCGCAGCTAAGGAGGCAGCTGCCAAGGAGGCGCAAATT GGGCAACCGACTCTTCCAAACAAT-3' |
|   | CHAN278 | 134 | 5'-ATTGTTTGGAAGAGTCGGTTGCCCAATTTGCGCCTCCTTGGCAGCTGCCTCCTTAGCTGCGGCGTCACCTTG TATAGGAGCCGGTTGACTTTCTTT-3' |
| 7 | CHAN279 | 135 | 5'-GCAGCTAAGGAGGCAGCTGCCAAGGAGGCGGCAGCCAAAGAAGCAGCAGCGAAGGAGGCAGCAGCGAAGCAA ATTGGGCAACCGACTCTTCCAAACAAT-3' |
|   | CHAN280 | 136 | 5'-ATTGTTTGGAAGAGTCGGTTGCCCAATTTGCTTCGCTGCTGCCTCCTTCGCTGCTGCTTCTTTGGCTGCCGC CTCCTTGGCAGCTGCCTCCTTAGCTGC-3' |
| 8 | CHAN281 | 137 | 5'-AAAGAAAGTCAACCGGCTCCTATACAAGGTAACGCCAAAGAGATGAAGGAGGCGGATAAGAAGGCTCAAATT GGGCAACCGACTCTTCCAAACAAT-3' |
|   | CHAN282 | 138 | 5'-ATTGTTTGGAAGAGTCGGTTGCCCAATTTGAGCCTTCTTATCCGCCTCCTTCATCTCTTTGGCGTTACCTTG TATAGGAGCCGGTTGACTTTCTTT-3' |
| 9 | CHAN283 | 139 | 5'-GCCAAAGAGATGAAGGAGGCGGATAAGAAGGCTCAGGAGAAGATCGCAGAAGCTATGAAGCAGTACGGTCAA ATTGGGCAACCGACTCTTCCAAACAAT-3' |

TABLE 9-continued

List of PCR oligonucleotide primer sets used to generate VP147 variants.

| Primer set | Primer identification | SEQ ID No: | Primer SEQUENCE |
|---|---|---|---|
| | CHAN284 | 140 | 5'-ATTGTTTGGAAGAGTCGGTTGCCCAATTTGACCGTACTGCTTCATAGCTTCTGCGATCTTCTCCTGAGCCTTCTTATCCGCCTCCTTCATCTCTTTGGC-3' |

TABLE 10

List of VP147 variants generated.

| Protein designation | SEQ ID NO: | Protein Identification[a] | PCR primer set (ref. Table 9) |
|---|---|---|---|
| VP147-R1 | 141 | 218-DEAIPSILPQFKRNKAQENSKLDEKVEEPSIRQ | 1 |
| VP147-R2 | 142 | 218-DEAIPQFKKDLTEEQIKAAQKHLEEVKTPSIRQ | 2 |
| VP147-R3 | 143 | 218-DEAIPQFKRNKAQENSKLDEKVEEPSIRQ | 3 |
| VP147-L1 | 144 | 268-PAPIQGDAAAKEAAAKEAAAKEAAAKEAAAKQIGQ | 6,7 |
| VP147-L2 | 145 | 268-PAPIQGNAKEMKEADKKAQEKIAEAMKQYGQIGQ | 8,9 |
| VP147-L3 | 146 | 268-PAPIQGSTNQYGNQTSGQIGQ | 4 |
| VP147-L4 | 147 | 268-PAPIQSETGNSTSNSTQIGQ | 5 |
| VP147-R2-L4 | 148 | 218-DEAIPQFKKDLTEEQIKAAQKHLEEVKT | 2,5 |
| | 147 | 268-PAPIQSETGNSTSNSTQIGQ | |

[a]Underlined amino acid residues correspond to the linker peptide sequence inserted into VP147. The numbers correspond to the location on VP147 (SEQ ID NO:3) of the pair of glycine residues which was substituted for the indicated peptide linker sequence.

EXAMPLE 10

This example illustrates the influence of the linker sequences on the reactivity of monoclonal antibodies with their corresponding epitopes.

The reactivity of the chimeric molecule VP147 and variants thereof was evaluated by ELISA using a panel of monoclonal antibodies (Mabs) raised against BVH-11-2 (Mabs H112-10A2, H112-14H6, H112-10G9, H112-10C5, H56-10B11, H112-4G9, H11B-11B8, H11B-13D5) or BVH-3 (HN1-14F6, HN1-3E5, H3V-4F3, H3V-2F2, HN1-12D8, H3V-7F4, HN52-6C6, HN1-2G2, H3-4D3, HN1-1G2) antigens. The results shown in Table 11 indicate that the insertion of peptide linker sequences could significantly improve the ELISA reactivity of several BVH-3- and BVH-11-2-reactive antibodies.

TABLE 11

ELISA reactivity of monoclonal antibodies with VP147 and variants thereof having inserted linker polypeptide sequences

| ELISA coating antigen | ELISA OD values obtained with MAbs | | | | | | | | |
|---|---|---|---|---|---|---|---|---|---|
| | H112-10A2 | H112-14H6 | H112-10G9 | H112-10C5 | H56-10B11 | H112-4G9 | HN1-14F6 | H3V-4F3 | HN1-3E5 |
| VP147-L1 | 1.56 | 0.25 | 0.81 | 1.10 | 0.45 | 0.09 | 2.78 | 1.75 | 0.46 |
| VP147-R2 | 1.00 | 0.78 | 0.48 | 0.90 | 0.22 | 0.34 | 2.50 | 1.50 | 1.39 |
| VP147-L4 | 1.65 | 0.27 | 0.88 | 1.25 | 0.43 | 0.11 | 2.78 | 2.01 | 0.40 |
| VP147-R2-L4 | 2.06 | 1.48 | 1.32 | 2.14 | 0.60 | 1.05 | 3.06 | 2.34 | 2.13 |
| VP147 | 1.54 | 0.26 | 0.84 | 1.01 | 0.34 | 0.09 | 1.94 | 1.92 | 0.39 |

Moreover, when variant molecules were used to immunize animals, specific immune responses were generated as evaluated by ELISA using heat-killed pneumococci cells or recombinant antigens as coating antigens. ELISA antibody titer was defined as the reciprocal sera dilution giving an OD value 0.1 over the background. ELISA antibody titers against RX-1 pneumococci cells were always greater than $10^4$ for sera from mice vaccinated with VP147 or variants of. Flow cytometry analysis using live encapsulated pneumococci revealed that the antibodies raised against the chimeric molecules bound to surface epitopes on both, BVH-3 and BVH-11-2 proteins.

SEQUENCE LISTING (160 sequences)

SEQ ID NO: 1 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 2 - protein, 272 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQ

SEQ ID NO: 3 - protein, 906 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 4 - DNA, 816 bp, Artificial Sequence
  Description of Artificial Sequence: Synthetic modified Streptococcus pneumoniae nucleotide sequence
atgcaaattacctacactgatgatgagattcaggtagccaagttggcaggcaagtacacaacagaagacggttatatctttgatactagttggattaaaaaagatagtttgtctgaagctgagagagcggcagcccaggcttatgctaaagagaaaggtttgacccctccttcgacagaccaccaggattcaggaaatactgaggcaaaaggagcagaagctatctacaaccgcgtgaaagcagctaagaaggtgccacttgatcgtatgccttacaatcttcagtatactgtagaagtcaaaaacggtagtttaatcatacctcatcatgaccattaccataacatcaaatttgagtggtttgacgaaggcctttatgaggcacctaaggggtatagtcttgaggatcttttggcgactgtcaagtactatgtcgaaccgcggaacgctagtgaccatgttcgtaaaaataaggcagaccaagatagtaaacctgatgaagataaggaacatgatgaagtaagtgagccaactcaccctgaatctgatgaaaaagagaatcacgctggtttaaatccttcagcagataatctttataaaccaagcactgatacggaagagacagaggaagaagctgaagataccacagatgaggctgaaattcctggtacccctagtattagacaaaatgctatggagacattgactggtctaaaaagtagtcttcttctcggaacgaaagataataacactatttcagcagaagtagatagtctcttggctttgttaaaagaaagtcaaccggctcctatacag

SEQ ID NO: 5 - DNA, 816 bp, Artificial Sequence; identical to SEQ ID NO: 4
  Description of Artificial Sequence: Synthetic modified Streptococcus pneumoniae nucleotide sequence

SEQ ID NO: 6 - DNA, 2721 bp, Artificial Sequence
  Description of Artificial Sequence: Synthetic modified Streptococcus pneumoniae nucleotide sequence
atgcaaattacctacactgatgatgagattcaggtagccaagttggcaggcaagtacacaacagaagacggttatatctttgatggtggttggattaaaaaagatagtttgtctgaagctgagagagcggcagcccaggcttatgctaaagagaaaggtttgacccctccttcgacagaccaccaggattcaggaaatactgaggcaaaaggagcagaagctatctacaaccgcgtgaaagcagctaagaaggtgccacttgatcgtatgccttacaatcttcagtatactgtagaagtcaaaaacggtagtttaatcatacctcatcatgaccattaccataacatcaaatttgagtggtttgacgaaggcctttatgaggcacctaaggggtatagtcttgaggatcttttggcgactgtcaagtactatgtcgaaggggggaacgctagtgaccatgttcgtaaaaataaggcagaccaagatagtaaacctgatgaagataaggaacatgatgaagtaagtgagccaactcaccctgaatctgatgaaaaagagaatcacgctggtttaaatccttcagcagataatctttataaaccaagcactgatacggaagagacagaggaagaagctgaagataccacagatgaggctgaaattcctggtggccctagtattagacaaaatgctatggagacattgactggtctaaaaagtagtcttcttctcggaacgaaagataataacactatttcagcagaagtagatagtctcttggctttgttaaaagaaagtcaaccggctcctatacaggggggccaaattgggcaaccgactcttccaaacaatagtctagcaacaccttctccatctcttccaatcaatccaggaacttcacatgagaaacatgaagaagatggatacggatttgatgctaatcgtattatcgctgaagatgaatcaggttttgtcatgagtcacggagactccaatcattatttcttcaagaaggacttgacagaagagcaaattaaggctgcgcaaaaacatttagaggaagttaaaactagtcataatggattagattctttgtcatctcatgaacaggattatccaggtaatgccaaagaaatgaaagatttagataaaaaaatcgaagaaaaaattgctggcattatgaaacaatatggtgtcaaacgtgaaagtattgtcgtgaataaagaaaaaaatgcgattatttatccgtctggagatcaccatcatgcagatccgattgatgaacataaaccggttggaattggtcattctcacagtaactatgaactgtttaaacccgaagaaggagttgctaaaaaagaagggaataaagtttatactggagaagaattaacgaatgttgttaatttgttaaaaaatagtacgtttaataatcaaaactttactctagccaatggtcaaaaacgcgtttcttttagttttccgcctgaattggagaaaaaattaggtatcaatatgctagtaaaattaataacaccagatggaaaagtattggagaaagtatctggtaaagtatttggagaaggagtagggaatattgcaaactttgaattagatcaaccttatttaccaggacaaacatttaagtatactatcgcttcaaaagattatccagaagtaagttatgatggtacatttacagttccaacctctttagcttacaaaatggccagtcaaacgattttctatcctttccatgcaggggatacttatttaagagtgaaccctcaatttgcagtgcctaaaggaactgatgctttagtcagagtgtttgatgaatttcatggaaatgcttatttagaaaataactataaagttggtgaaatcaaattaccgattccgaaattaaaccaaggaacaaccagaacggccggaaataaaattcctgtaaccttcatggcaaatgcttatttggacaatcaatcgacttatattgtggaagtacctatcttggaaaaagaaaatcaaactgataaaccaagtattctaccacaatttaaaaggaataaagcacaagaaaactcaaaacttgatgaaaaggtagaagaaccaaagactagtgagaaggtagaaaaagaaaaactttctgaaactgggaatagtactagtaattcaacgttagaagaagttcctacagtggatcctgtacaagaaaaagtagcaaaatttgctgaaagttatgggatgaagctagaaaatgtcttgtttaatatggacggaacaattgaattatatttaccatcaggagaagtcattaaaaagaatatggcagattttacaggagaagcacctcaaggaaatggtgaaaataaaccatctgaaaatggaaaagtatctactggaacagttgagaaccaaccaacagaaaataaaccagcagattctttaccagaggcaccaaacgaaaaacctgtaaaaccagaaaactcaacggataatggaatgttgaatccagaagggaatgtggggagtgaccctatgttagatccagcattagaggaagctccagcagtagatcctgtacaagaaaaattagaaaaatttacagctagttacggattaggcttagatagtgttatattcaatatggatggaacgattgaattaagattgccaagtggagaagtgataaaaaagaatttatctgatttcatagcgtaa

SEQ ID NO: 7 - protein, 1039 aa, Artificial Sequence
  Description of Artificial Sequence: Synthetic modified Streptococcus pneumoniae protein sequence
MKFSKKYIAAGSAVIVSLSLCAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 8 - protein, 840 aa, Artificial Sequence
  Description of Artificial Sequence: Synthetic modified Streptococcus pneumoniae protein sequence
MKINKKYLAGSVATLVLSVCAYELGLHQAQTVKENNRVSYIDGKQATQKTENLTPDEVSKREGINAEQIVIKITDQGYVTSHGDHYHYYNGKVPYDAIISEELLMKDPNYQLKDSDIVNEIKGGYVIKVNGKYYVYLKDAAHADNVRTKEEINRQKQEHSQHREGGTSANDGAVAFARSQGRYTTDDGYIFNASDIIEDTGDAYIVPHGDHYHYIPKNELSASELAAAEAFLSGRENLSNLRTYRRQNSDNTPRTNWVPSVSNPGTTNTNTSNNSNTNSQASQSNDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 9 - protein, 838 aa, Artificial Sequence
  Description of Artificial Sequence: Synthetic modified Streptococcus pneumoniae protein sequence
MKINKKYLAGSVAVLALSVCSYELGRHQAGQVKKESNRVSYIDGDQAGQKAENLTPDEVSKREGINAEQIVIKITDQGYVTSHGDHYHYYNGKVPYDAIISEELLMKDPNYQLKDSDIVNEIKGGYVIKVDGKYYVYLKDAAHADNIRTKEEIKRQKQEHSHNHNSRADNAVAAARAQGRYTTDDGYIFNASDIIEDTGDAYIVPHGDHYHYIPKNELSASELAAAEAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 10 - DNA, 819 bp, Artificial Sequence
  Description of Artificial Sequence: Synthetic modified Streptococcus pneumoniae nucleotide sequence
atgcaaattacctacactgatgatgagattcaggtagccaagttggcaggcaagtacacaacagaagacggttatatctttgatactagttggattaaaaaagatagtttgtctgaagctgagagagcggcagcccaggcttatgctaaagagaaaggtttgacccctccttcgacagaccaccaggattcaggaaatactgaggcaaaaggagcagaagctatctacaaccgcgtgaaagcagctaagaaggtgccacttgatcgtatgccttacaatcttcagtatactgtagaagtcaaaaacggtagtttaatcatacctcattatgaccattaccataacatcaaatttgagtggtttgacgaaggcctttatgaggcacctaaggggtatagtcttgaggatcttttggcgactgtcaagtactatgtcgaaccgcggaacgctagtgaccatgttcgtaaaaataaggcagaccaagatagtaaacctgatgaagataaggaacatgatgaagtaagtgagccaactcaccctgaatctgatgaaaaagagaatcacgctggtttaaatccttcagcagataatctttataaaccaagcactgatacggaagagacagaggaagaagctgaagataccacagatgaggctgaaattcctggtacccctagtattagacaaaatgctatggagacattgactggtctaaaaagtagtcttcttctcggaacgaaagataataacactatttcagcagaagtagatagtctcttggctttgttaaaagaaagtcaaccggctcctatacagtag

SEQ ID NO: 11 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 12 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 13 - protein, 266 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 14 - protein, 1019 aa, Artificial Sequence
  Description of Artificial Sequence: Synthetic modified Streptococcus pneumoniae protein sequence
CAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 15 - protein, 489 aa, Artificial Sequence
  Description of Artificial Sequence: Synthetic modified Streptococcus pneumoniae protein sequence
CAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNA

SEQ ID NO: 16 - protein, 509 aa, Artificial Sequence
  Description of Artificial Sequence: Synthetic modified Streptococcus pneumoniae protein sequence
MKFSKKYIAAGSAVIVSLSLCAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNA

SEQ ID NO: 17 - protein, 528 aa, Artificial Sequence
  Description of Artificial Sequence: Synthetic modified Streptococcus pneumoniae protein sequence
MKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 18 - protein, 205 aa, Artificial Sequence
  Description of Artificial Sequence: Synthetic modified Streptococcus pneumoniae protein sequence
CAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAA

SEQ ID NO: 19 - protein, 821 aa, Artificial Sequence
  Description of Artificial Sequence: Synthetic modified Streptococcus pneumoniae protein sequence
CAYELGLHQAQTVKENNRVSYIDGKQATQKTENLTPDEVSKREGINAEQIVIKITDQGYVTSHGDHYHYYNGKVPYDAIISEELLMKDPNYQLKDSDIVNEIKGGYVIKVNGKYYVYLKDAAHADNVRTKEEINRQKQEHSQHREGGTSANDGAVAFARSQGRYTTDDGYIFNASDIIEDTGDAYIVPHGDHYHYIPKNELSASELAAAEAFLSGRENLSNLRTYRRQNSDNTPRTNWVPSVSNPGTTNTNTSNNSNTNSQASQSNDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 20 - protein, 334 aa, Artificial Sequence
  Description of Artificial Sequence: Synthetic modified Streptococcus pneumoniae protein sequence
CAYELGLHQAQTVKENNRVSYIDGKQATQKTENLTPDEVSKREGINAEQIVIKITDQGYVTSHGDHYHYYNGKVPYDAIISEELLMKDPNYQLKDSDIVNEIKGGYVIKVNGKYYVYLKDAAHADNVRTKEEINRQKQEHSQHREGGTSANDGAVAFARSQGRYTTDDGYIFNASDIIEDTGDAYIVPHGDHYHYIPKNELSASELAAAEAFLSGRENLSNLRTYRRQNSDNTPRTNWVPSVSNPGTTNTNTSNNSNTNSQASQSNDIDSLLKQLYKLPLSQRHVESDGLIFDPAQITSRTARGVAVPHGNHYHFIPYEQMSELEKRIARIIPL

SEQ ID NO: 21 - protein, 487 aa, Artificial Sequence
  Description of Artificial Sequence: Synthetic modified Streptococcus pneumoniae protein sequence
RYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 22 - protein, 613 aa, Artificial Sequence
  Description of Artificial Sequence: Synthetic modified Streptococcus pneumoniae protein sequence
AEAFLSGRENLSNLRTYRRQNSDNTPRTNWVPSVSNPGTTNTNTSNNSNTNSQASQSNDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 23 - protein, 568 aa, Artificial Sequence
  Description of Artificial Sequence: Synthetic modified Streptococcus pneumoniae protein sequence
DLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 24 - protein, 329 aa, Artificial Sequence
  Description of Artificial Sequence: Synthetic modified Streptococcus pneumoniae protein sequence
DLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVE

SEQ ID NO: 25 - protein, 240 aa, Artificial Sequence
  Description of Artificial Sequence: Synthetic modified Streptococcus pneumoniae protein sequence
EVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 26 - protein, 555 aa, Artificial Sequence
  Description of Artificial Sequence: Synthetic modified Streptococcus pneumoniae protein sequence
DIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 27 - protein, 428 aa, Artificial Sequence
  Description of Artificial Sequence: Synthetic modified Streptococcus pneumoniae protein sequence
DIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHV

SEQ ID NO: 28 - protein, 121 aa, Artificial Sequence
  Description of Artificial Sequence: Synthetic modified Streptococcus pneumoniae protein sequence
GLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLL

SEQ ID NO: 29 - protein, 132 aa, Artificial Sequence
  Description of Artificial Sequence: Synthetic modified Streptococcus pneumoniae protein sequence
ASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 30 - protein, 226 aa, Artificial Sequence
  Description of Artificial Sequence: Synthetic modified Streptococcus pneumoniae protein sequence
DIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDD

SEQ ID NO: 31 - protein, 203 aa, Artificial Sequence
  Description of Artificial Sequence: Synthetic modified Streptococcus pneumoniae protein sequence
DILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHV

SEQ ID NO: 32 - protein, 819 aa, Artificial Sequence
  Description of Artificial Sequence: Synthetic modified Streptococcus pneumoniae protein sequence
CSYELGRHQAGQVKKESNRVSYIDGDQAGQKAENLTPDEVSKREGINAEQIVIKITDQGYVTSHGDHYHYYNGKVPYDAIISEELLMKDPNYQLKDSDIVNEIKGGYVIKVDGKYYVYLKDAAHADNIRTKEEIKRQKQEHSHNHNSRADNAVAAARAQGRYTTDDGYIFNASDIIEDTGDAYIVPHGDHYHYIPKNELSASELAAAEAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 33 - protein, 568 aa, Artificial Sequence
  Description of Artificial Sequence: Synthetic modified Streptococcus pneumoniae protein sequence
ENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 34 - protein, 140 aa, Artificial Sequence
  Description of Artificial Sequence: Synthetic modified Streptococcus pneumoniae protein sequence
VRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 35 - protein, 487 aa, Artificial Sequence; identical to SEQ ID NO: 21
  Description of Artificial Sequence: Synthetic modified Streptococcus pneumoniae protein sequence

SEQ ID NO: 36 - protein, 473 aa, Artificial Sequence
  Description of Artificial Sequence: Synthetic modified Streptococcus pneumoniae protein sequence
EAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHV

SEQ ID NO: 37 - protein, 780 aa, Artificial Sequence
  Description of Artificial Sequence: Synthetic modified Streptococcus pneumoniae protein sequence
CAYALNQHRSQENKDNNRVSYVDGSQSSQKSENLTPDQVSQKEGIQAEQIVIKITDQGYVTSHGDHYHYYNGKVPYDALFSEELLMKDPNYQLKDADIVNEVKGGYIIKVDGKYYVYLKDAAHADNVRTKDEINRQKQEHVKDNEKVNSNVAVARSQGRYTTNDGYVFNPADIIEDTGNAYIVPHGGHYHYIPKSDLSASELAAAKAHLAGKNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVE

SEQ ID NO: 38 - protein, 690 aa, Artificial Sequence
  Description of Artificial Sequence: Synthetic modified Streptococcus pneumoniae protein sequence
CAYELGLHQAQTVKENNRVSYIDGKQATQKTENLTPDEVSKREGINAEQIVIKITDQGYVTSHGDHYHYYNGKVPYDAIISEELLMKDPNYQLKDSDIVNEIKGGYVIKVNGKYYVYLKDAAHADNVRTKEEINRQKQEHSQHREGGTSANDGAVAFARSQGRYTTDDGYIFNASDIIEDTGDAYIVPHGDHYHYIPKNELSASELAAAEAFLSGRENLSNLRTYRRQNSDNTPRTNWVPSVSNPGTTNTNTSNNSNTNSQASQSNDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNA

SEQ ID NO: 39 - protein, 294 aa, Artificial Sequence
  Description of Artificial Sequence: Synthetic modified Streptococcus pneumoniae protein sequence
EAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITY

SEQ ID NO: 40 - protein, 342 aa, Artificial Sequence
  Description of Artificial Sequence: Synthetic modified Streptococcus pneumoniae protein sequence
DILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 41 - protein, 644 aa, Artificial Sequence
  Description of Artificial Sequence: Synthetic modified Streptococcus pneumoniae protein sequence
HGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 42 - protein, 214 aa, Artificial Sequence
  Description of Artificial Sequence: Synthetic modified Streptococcus pneumoniae protein sequence
NMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDA

SEQ ID NO: 43 - protein, 112 aa, Artificial Sequence
  Description of Artificial Sequence: Synthetic modified Streptococcus pneumoniae protein sequence
DHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNA

SEQ ID NO: 44 - protein, 612 aa, Artificial Sequence
  Description of Artificial Sequence: Synthetic modified Streptococcus pneumoniae protein sequence
EAYWNGKQGSRPSSSSSYNANPVQPRLSENHNLTVTPTYHQNQGENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQ

SEQ ID NO: 45 - protein, 807 aa, Artificial Sequence
  Description of Artificial Sequence: Synthetic modified Streptococcus pneumoniae protein sequence
NMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 46 - protein, 1058 aa, Artificial Sequence
  Description of Artificial Sequence: Synthetic modified Streptococcus pneumoniae protein sequence
MDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAKLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESK

SEQ ID NO: 47 - protein, 999 aa, Artificial Sequence
  Description of Artificial Sequence: Synthetic modified Streptococcus pneumoniae protein sequence
MDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVGPDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 48 - protein, 999 aa, Artificial Sequence
  Description of Artificial Sequence: Synthetic modified Streptococcus pneumoniae protein sequence
MDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAGPDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHV

SEQ ID NO: 49 - protein, 1378 aa, Artificial Sequence
  Description of Artificial Sequence: Synthetic modified Streptococcus pneumoniae protein sequence
MENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQGPNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 50 - protein, 1152 aa, Artificial Sequence
  Description of Artificial Sequence: Synthetic modified Streptococcus pneumoniae protein sequence
MDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQGPNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 51 - protein, 1139 aa, Artificial Sequence
  Description of Artificial Sequence: Synthetic modified Streptococcus pneumoniae protein sequence
MENISSLLRELYAKPLSERHVESDGLIFDPAQITSRTARGVAVPHGNHYHFIPYEQMSELEKRIARIIPLRYRSNHWVPDSRPEQPSPQSTPEPSPSLQPAPNPQPAPSNPIDEKLVKEAVRKVGDGYVFEENGVSRYIPAKDLSAETAAGIDSKLAKQESLSHKLGAKKTDLPSSDREFYNKAYDLLARIHQDLLDNKGRQVDFEVLDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQGPDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 52 - protein, 1238 aa, Artificial Sequence
  Description of Artificial Sequence: Synthetic modified Streptococcus pneumoniae protein sequence
MDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVGPNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 53 - protein, 1365 aa, Artificial Sequence
  Description of Artificial Sequence: Synthetic modified Streptococcus pneumoniae protein sequence
MDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESKGPNMQPSQLSYSSTASDNNTQSVAKGSTSKPANKSENLQSLLKELYDSPSAQRYSESDGLVFDPAKIISRTPNGVAIPHGDHYHFIPYSKLSALEEKIARMVPISGTGSTVSTNAKPNEVVSSLGSLSSNPSSLTTSKELSSASDGYIFNPKDIVEETATAYIVRHGDHFHYIPKSNQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 54 - protein, 1126 aa, Artificial Sequence
  Description of Artificial Sequence: Synthetic modified Streptococcus pneumoniae protein sequence
MDIDSLLKQLYKLPLSQRHVESDGLIFDPAQITSRTARGVAVPHGNHYHFIPYEQMSELEKRIARIIPLRYRSNHWVPDSRPEEPSPQPTPEPSPSPQPAPNPQPAPSNPIDEKLVKEAVRKVGDGYVFEENGVSRYIPAKNLSAETAAGIDSKLAKQESLSHKLGAKKTDLPSSDREFYNKAYDLLARIHQDLLDNKGRQVDFEALDNLLERLKDVSSDKVKLVDDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYTLEDLLATVKYYVEHPNERPHSDNGFGNASDHVQRNKNGQADTNQTEKPSEEKPQTEKPEEETPREEKPQSEKPESPKPTEEPEEESPEESEEPQVETEKVEEKLREAEDLLGKIQDPIIKSNAKETLTGLKNNLLFGTQDNNTIMAEAEKLLALLKESKGPDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 55 - protein, 913 aa, Artificial Sequence
  Description of Artificial Sequence: Synthetic modified Streptococcus pneumoniae protein sequence
MDILAFLAPIRHPERLGKPNAQITYTDDEIQVAKLAGKYTTEDGYIFDPRDITSDEGDAYVTPHMTHSHWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEHPNERPHSDNGFGNASDHVRKNKADQDSKPDEDKEHDEVSEPTHPESDEKENHAGLNPSADNLYKPSTDTEETEEEAEDTTDEAEIPQVENSVINAKIADAEALLEKVTDPSIRQNAMETLTGLKSSLLLGTKDNNTISAEVDSLLALLKESQPAPIQGPDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 56 - protein, 568 aa, Artificial Sequence; identical to SEQ ID NO: 23
  Description of Artificial Sequence: Synthetic modified Streptococcus pneumoniae protein sequence

SEQ ID NO: 57 - protein, 568 aa, Artificial Sequence
  Description of Artificial Sequence: Synthetic modified Streptococcus pneumoniae protein sequence
DLTEEQIKAAQKHLEEVKTSHNGLDSLSSHEQDYPGNAKEMKDLDKKIEEKIAGIMKQYGVKRESIVVNKEKNAIIYPSGDGTSADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 58 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSSGDSNSYFFKKDLTEEQIKAAQKHLEEVKTSHNGLDSLSSHEQDYPGNAKEMKDLDKKIEEKIAGIMKQYGVKRESIVVNKEKNAIIYPSGDGTSADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 59 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSSGDHNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 60 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSSGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 61 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSSGDHNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 62 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSSGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDGHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 63 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 64 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPSGDGHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 65 - protein, 568 aa, Artificial Sequence
  Description of Artificial Sequence: Synthetic modified Streptococcus pneumoniae protein sequence
DLTEEQIKAAQKHLEEVKTSHNGLDSLSSHEQDYPGNAKEMKDLDKKIEEKIAGIMKQYGVKRESIVVNKEKNAIIYPHGDGHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 66 - protein, 633 aa, Artificial Sequence; identical to SEQ ID NO: 12
  Description of Artificial Sequence: Synthetic modified Streptococcus pneumoniae protein sequence

SEQ ID NO: 67 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 68 - protein, 633 aa, Artificial Sequence; identical to SEQ ID NO: 67
  Description of Artificial Sequence: Synthetic modified Streptococcus pneumoniae protein sequence

SEQ ID NO: 69 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDHNSYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 70 - protein, 633 aa, Artificial Sequence; identical to SEQ ID NO: 67
  Description of Artificial Sequence: Synthetic modified Streptococcus pneumoniae protein sequence

SEQ ID NO: 71 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDHNSYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 72 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDGHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 73 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDHNSYFFKKDLTEEQIKAAQKHLEEVKTSHNGLDSLSSHEQDYPGNAKEMKDLDKKIEEKIAGIMKQYGVKRESIVVNKEKNAIIYPHGDGHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 74 - protein, 633 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDHNSYFFKKDLTEEQIKAAQKHLEEVKTSHNGLDSLSSHEQDYPGNAKEMKDLDKKIEEKIAGIMKQYGVKRESIVVNKEKNAIIYPSGDGHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 75 - protein, 627 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 76 - protein, 627 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSHGDHNHYFFKKDLTEEQIKAAQKHLEEVKTSHNGLDSLSSHEQDYPGNAKEMKDLDKKIEEKIAGIMKQYGVKRESIVVNKEKNAIIYPADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 77 - protein, 621 aa, Artificial Sequence
  Description of Artificial Sequence: Synthetic modified Streptococcus pneumoniae protein sequence
MQIGQPTLPNNSLATPSPSLPINPGTSHEKHEEDGYGFDANRIIAEDESGFVMSYFFKKDLTEEQIKAAQKHLEEVKTSHNGLDSLSSHEQDYPGNAKEMKDLDKKIEEKIAGIMKQYGVKRESIVVNKEKNAIIYPADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 78 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPSYDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 79 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHYDSYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 80 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHYDHYSNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 81 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPSYDSYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 82 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPSYDSYSNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 83 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHYDSYSNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 84 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPSYDHYSNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 85 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPSKDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 86 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHKDSYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 87 - protein, 270 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 88 - protein, 268 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 89 - protein, 266 aa, Artificial Sequence; identical to SEQ ID NO: 13
  Description of Artificial Sequence: Synthetic modified Streptococcus pneumoniae protein sequence

SEQ ID NO: 90 - protein, 902 aa, Artificial Sequence
  Description of Artificial Sequence: Synthetic modified Streptococcus pneumoniae protein sequence
MMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAGPMQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 91 - protein, 902 aa, Artificial Sequence
  Description of Artificial Sequence: Synthetic modified Streptococcus pneumoniae protein sequence
MMQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQGPMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 92 - protein, 272 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 93 - protein, 272 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHYDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQ

SEQ ID NO: 94 - protein, 272 aa, Artificial Sequence; identical to SEQ ID NO: 93
  Description of Artificial Sequence: Synthetic modified Streptococcus pneumoniae protein sequence

SEQ ID NO: 95 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHYYNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 96 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPYHDHYYNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 97 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHYDHHHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 98 - protein, 272 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHHHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 99 - protein, 272 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYYNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQ

SEQ ID NO: 100 - protein, 266 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 101 - protein, 266 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQ

SEQ ID NO: 102 - protein, 266 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQ

SEQ ID NO: 103 - protein, 901 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGGMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 104 - protein, 901 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQGGMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 105 - protein, 907 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHYDHHHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGGMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 106 - protein, 907 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHHHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGGMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 107 - protein, 842 aa, Artificial Sequence
  Description of Artificial Sequence: Synthetic modified Streptococcus pneumoniae protein sequence
MQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHYYNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQGGDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 108 - protein, 908 aa, Artificial Sequence
  Description of Artificial Sequence: Synthetic modified Streptococcus pneumoniae protein sequence
MMQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQGPMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 109 - protein, 908 aa, Artificial Sequence
  Description of Artificial Sequence: Synthetic modified Streptococcus pneumoniae protein sequence
MMQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQGGMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 110 - protein, 908 aa, Artificial Sequence
  Description of Artificial Sequence: Synthetic modified Streptococcus pneumoniae protein sequence
MMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAGPMQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 111 - protein, 908 aa, Artificial Sequence
  Description of Artificial Sequence: Synthetic modified Streptococcus pneumoniae protein sequence
MMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAGGMQITYTDDEIQVAKLAGKYTTEDGYIFDTSWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEPRNASDHVRKNKADQDSKPDEDKEHDEVSEPTHPESDEKENHAGLNPSADNLYKPSTDTEETEEEAEDTTDEAEIPGTPSIRQNAMETLTGLKSSLLLGTKDNNTISAEVDSLLALLKESQPAPIQ

SEQ ID NO: 112 - protein, 908 aa, Artificial Sequence
  Description of Artificial Sequence: Synthetic modified Streptococcus pneumoniae protein sequence
MMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAGPMQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQ

SEQ ID NO: 113 - protein, 908 aa, Artificial Sequence
  Description of Artificial Sequence: Synthetic modified Streptococcus pneumoniae protein sequence
MMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAGGMQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQ

SEQ ID NO: 114 - protein, 908 aa, Artificial Sequence
  Description of Artificial Sequence: Synthetic modified Streptococcus pneumoniae protein sequence
MMQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGGMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 115 - protein, 908 aa, Artificial Sequence
  Description of Artificial Sequence: Synthetic modified Streptococcus pneumoniae protein sequence
MMQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGPMQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPHGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIA

SEQ ID NO: 116 - protein, 23 aa, Artificial Sequence
  Description of Artificial Sequence: Synthetic linker peptide
SILPQFKRNKAQENSKLDEKVEE

SEQ ID NO: 117 - protein, 23 aa, Artificial Sequence
  Description of Artificial Sequence: Synthetic linker peptide
QFKKDLTEEQIKAAQKHLEEVKT

SEQ ID NO: 118 - protein, 19 aa, Artificial Sequence
  Description of Artificial Sequence: Synthetic linker peptide
QFKRNKAQENSKLDEKVEE

SEQ ID NO: 119 - protein, 26 aa, Artificial Sequence
  Description of Artificial Sequence: Synthetic linker peptide
GDAAAKEAAAKEAAAKEAAAKEAAAK

SEQ ID NO: 120 - protein, 25 aa, Artificial Sequence
  Description of Artificial Sequence: Synthetic linker peptide
GNAKEMKEADKKAQEKIAEAMKQYG

SEQ ID NO: 121 - protein, 12 aa, Artificial Sequence
  Description of Artificial Sequence: Synthetic linker peptide
GSTNQYGNQTSG

SEQ ID NO: 122 - protein, 11 aa, Artificial Sequence
  Description of Artificial Sequence: Synthetic linker peptide
SETGNSTSNST

SEQ ID NO: 123 - DNA, 129 bp, Artificial Sequence
  Description of Artificial Sequence: Primer
gaagataccacagatgaggctgaaattccttccatcttgcctcagttcaagcgaaacaaagctcaggagaattccaaactcgacgaaaaagtcgaagagcctagtattagacaaaatgctatggagaca

SEQ ID NO: 124 - DNA, 129 bp, Artificial Sequence
  Description of Artificial Sequence: Primer
tgtctccatagcattttgtctaatactaggctcttcgactttttcgtcgagtttggaattctcctgagctttgtttcgcttgaactgaggcaagatggaaggaatttcagcctcatctgtggtatcttc

SEQ ID NO: 125 - DNA, 129 bp, Artificial Sequence
  Description of Artificial Sequence: Primer
gaagataccacagatgaggctgaaattcctcaattcaagaaagatctcacggaggaacagatcaaagcagcacagaagcacctggaagaggtcaagacccctagtattagacaaaatgctatggagaca

SEQ ID NO: 126 - DNA, 129 bp, Artificial Sequence
  Description of Artificial Sequence: Primer
tgtctccatagcattttgtctaatactaggggtcttgacctcttccaggtgcttctgtgctgctttgatctgttcctccgtgagatctttcttgaattgaggaatttcagcctcatctgtggtatcttc

SEQ ID NO: 127 - DNA, 117 bp, Artificial Sequence
  Description of Artificial Sequence: Primer
gaagataccacagatgaggctgaaattcctcaattcaagcgcaacaaggctcaagagaattccaagttggacgagaaagtcgaggaacctagtattagacaaaatgctatggagaca

SEQ ID NO: 128 - DNA, 117 bp, Artificial Sequence
  Description of Artificial Sequence: Primer
tgtctccatagcattttgtctaatactaggttcctcgactttctcgtccaacttggaattctcttgagccttgttgcgcttgaattgaggaatttcagcctcatctgtggtatcttc

SEQ ID NO: 129 - DNA, 93 bp, Artificial Sequence
  Description of Artificial Sequence: Primer
aaagaaagtcaaccggctcctatacaaggttccaccaatcagtacggcaatcaaacctctgggcaaattgggcaaccgactcttccaaacaat

SEQ ID NO: 130 - DNA, 93 bp, Artificial Sequence
  Description of Artificial Sequence: Primer
attgtttggaagagtcggttgcccaatttgcccagaggtttgattgccgtactgattggtggaaccttgtataggagccggttgactttcttt

SEQ ID NO: 131 - DNA, 93 bp, Artificial Sequence
  Description of Artificial Sequence: Primer
ttaaaagaaagtcaaccggctcctatacagtccgagacaggtaactctacgtccaacagcacgcaaattgggcaaccgactcttccaaacaat

SEQ ID NO: 132 - DNA, 93 bp, Artificial Sequence
  Description of Artificial Sequence: Primer
attgtttggaagagtcggttgcccaatttgcgtgctgttggacgtagagttacctgtctcggactgtataggagccggttgactttcttttaa

SEQ ID NO: 133 - DNA, 96 bp, Artificial Sequence
  Description of Artificial Sequence: Primer
aaagaaagtcaaccggctcctatacaaggtgacgccgcagctaaggaggcagctgccaaggaggcgcaaattgggcaaccgactcttccaaacaat

SEQ ID NO: 134 - DNA, 96 bp, Artificial Sequence
  Description of Artificial Sequence: Primer
attgtttggaagagtcggttgcccaatttgcgcctccttggcagctgcctccttagctgcggcgtcaccttgtataggagccggttgactttcttt

SEQ ID NO: 135 - DNA, 99 bp, Artificial Sequence
  Description of Artificial Sequence: Primer
gcagctaaggaggcagctgccaaggaggcggcagccaaagaagcagcagcgaaggaggcagcagcgaagcaaattgggcaaccgactcttccaaacaat

SEQ ID NO: 136 - DNA, 99 bp, Artificial Sequence
  Description of Artificial Sequence: Primer
attgtttggaagagtcggttgcccaatttgcttcgctgctgcctccttcgctgctgcttctttggctgccgcctccttggcagctgcctccttagctgc

SEQ ID NO: 137 - DNA, 96 bp, Artificial Sequence
  Description of Artificial Sequence: Primer
aaagaaagtcaaccggctcctatacaaggtaacgccaaagagatgaaggaggcggataagaaggctcaaattgggcaaccgactcttccaaacaat

SEQ ID NO: 138 - DNA, 96 bp, Artificial Sequence
  Description of Artificial Sequence: Primer
attgtttggaagagtcggttgcccaatttgagccttcttatccgcctccttcatctctttggcgttaccttgtataggagccggttgactttcttt

SEQ ID NO: 139 - DNA, 99 bp, Artificial Sequence
  Description of Artificial Sequence: Primer
gccaaagagatgaaggaggcggataagaaggctcaggagaagatcgcagaagctatgaagcagtacggtcaaattgggcaaccgactcttccaaacaat

SEQ ID NO: 140 - DNA, 99 bp, Artificial Sequence
  Description of Artificial Sequence: Primer
attgtttggaagagtcggttgcccaatttgaccgtactgcttcatagcttctgcgatcttctcctgagccttcttatccgcctccttcatctctttggc

SEQ ID NO: 141 - protein, 33 aa, Artificial Sequence
  Description of Artificial Sequence: Synthetic modified Streptococcus pneumoniae protein sequence
DEAIPSILPQFKRNKAQENSKLDEKVEEPSIRQ

SEQ ID NO: 142 - protein, 33 aa, Artificial Sequence
  Description of Artificial Sequence: Synthetic modified Streptococcus pneumoniae protein sequence
DEAIPQFKKDLTEEQIKAAQKHLEEVKTPSIRQ

SEQ ID NO: 143 - protein, 29 aa, Artificial Sequence
  Description of Artificial Sequence: Synthetic modified Streptococcus pneumoniae protein sequence
DEAIPQFKRNKAQENSKLDEKVEEPSIRQ

SEQ ID NO: 144 - protein, 29 aa, Artificial Sequence
  Description of Artificial Sequence: Synthetic modified Streptococcus pneumoniae protein sequence
DEAIPQFKRNKAQENSKLDEKVEEPSIRQ

SEQ ID NO: 145 - protein, 34 aa, Artificial Sequence
  Description of Artificial Sequence: Synthetic modified Streptococcus pneumoniae protein sequence
PAPIQGNAKEMKEADKKAQEKIAEAMKQYGQIGQ

SEQ ID NO: 146 - protein, 21 aa, Artificial Sequence
  Description of Artificial Sequence: Synthetic modified Streptococcus pneumoniae protein sequence
PAPIQGSTNQYGNQTSGQIGQ

SEQ ID NO: 147 - protein, 20 aa, Artificial Sequence
  Description of Artificial Sequence: Synthetic modified Streptococcus pneumoniae protein sequence
PAPIQSETGNSTSNSTQIGQ

SEQ ID NO: 148 - protein, 28 aa, Artificial Sequence
  Description of Artificial Sequence: Synthetic modified Streptococcus pneumoniae protein sequence
DEAIPQFKKDLTEEQIKAAQKHLEEVKT

SEQ ID NO: 149 - protein, 908 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 150 - protein, 929 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPSILPQFKRNKAQENSKLDEKVEEPSIRQNAMETLTGLKSSLLLGTKDNNTISAEVDSLLALLKESQPAPIQGGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 151 - protein, 929 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPQFKKDLTEEQIKAAQKHLEEVKTPSIRQNAMETLTGLKSSLLLGTKDNNTISAEVDSLLALLKESQPAPIQGGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 152 - protein, 925 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPQFKRNKAQENSKLDEKVEEPSIRQNAMETLTGLKSSLLLGTKDNNTISAEVDSLLALLKESQPAPIQGGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 153 - protein, 932 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGDAAAKEAAAKEAAAKEAAAKEAAAKQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 154 - protein, 931 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGNAKEMKEADKKAQEKIAEAMKQYGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 155 - protein, 918 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQGSTNQYGNQTSGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 156 - protein, 917 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGGPSIRQNAMETLTGLKSSLLLGTKDNNTISAEVDSLLALLKESQPAPIQSETGNSTSNSTQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 157 - protein, 938 aa, Artificial Sequence
  Description of Artificial Sequence: Synthetic modified Streptococcus pneumoniae protein sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPQFKKDLTEEQIKAAQKHLEEVKTPSIRQNAMETLTGLKSSLLLGTKDNNTISAEVDSLLALLKESQPAPIQSETGNSTSNSTQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 158 - protein, 907 aa, Artificial Sequence
  Description of Artificial Sequence: Consensus sequence
MQITYTDDEIQVAKLAGKYTTEDGYIFDGGWIKKDSLSEAERAAAQAYAKEKGLTPPSTDHQDSGNTEAKGAEAIYNRVKAAKKVPLDRMPYNLQYTVEVKNGSLIIPHHDHYHNIKFEWFDEGLYEAPKGYSLEDLLATVKYYVEGGNASDHVRKNKADQDSKPDEDKEHDEVSEPTHPESDEKENHAGLNPSADNLYKPSTDTEETEEEAEDTTDEAEIPGPSIRQNAMETLTGLKSSLLLGTKDNNTISAEVDSLLALLKESQPAPIQGGQIGQPTLPNNSLATPSPSLPINPGTSHEKHEEDGYGFDANRIIAEDESGFVMSHGDSNHYFFKKDLTEEQIKAAQKHLEEVKTSHNGLDSLSSHEQDYPGNAKEMKDLDKKIEEKIAGIMKQYGVKRESIVVNKEKNAIIYPSGDHHHADPIDEHKPVGIGHSHSNYELFKPEEGVAKKEGNKVYTGEELTNVVNLLKNSTFNNQNFTLANGQKRVSFSFPPELEKKLGINMLVKLITPDGKVLEKVSGKVFGEGVGNIANFELDQPYLPGQTFKYTIASKDYPEVSYDGTFTVPTSLAYKMASQTIFYPFHAGDTYLRVNPQFAVPKGTDALVRVFDEFHGNAYLENNYKVGEIKLPIPKLNQGTTRTAGNKIPVTFMANAYLDNQSTYIVEVPILEKENQTDKPSILPQFKRNKAQENSKLDEKVEEPKTSEKVEKEKLSETGNSTSNSTLEEVPTVDPVQEKVAKFAESYGMKLENVLFNMDGTIELYLPSGEVIKKNMADFTGEAPQGNGENKPSENGKVSTGTVENQPTENKPADSLPEAPNEKPVKPENSTDNGMLNPEGNVGSDPMLDPALEEAPAVDPVQEKLEKFTASYGLGLDSVIFNMDGTIELRLPSGEVIKKNLSDFIAAA

SEQ ID NO: 159 - protein, 36 aa, Artificial Sequence
  Description of Artificial Sequence: Illustrative peptide
  MOD_RES (2)..(3): Variable amino acid
  MOD_RES (5): Variable amino acid
  MOD_RES (8)..(9): Variable amino acid
  MOD_RES (11): Variable amino acid
  MOD_RES (14)..(15): Variable amino acid
  MOD_RES (17): Variable amino acid
  MOD_RES (20)..(21): Variable amino acid
  MOD_RES (23): Variable amino acid
  MOD_RES (26)..(27): Variable amino acid
  MOD_RES (29): Variable amino acid
  MOD_RES (32)..(33): Variable amino acid
  MOD_RES (35): Variable amino acid
  this sequence may encompass 30-36 residues according to the specification as filed
HXXHXHHXXHXHHXXHXHHXXHXHHXXHXHHXXHXH

SEQ ID NO: 160 - protein, 6 aa, Artificial Sequence
  Description of Artificial Sequence: Illustrative peptide
  MOD_RES (5): Variable amino acid
HGDHXH

What is claimed is:

1. An isolated polynucleotide comprising a polynucleotide sequence encoding a polypeptide that comprises the amino acid sequence set forth in SEQ ID NO:3, or the complement of the full-length polynucleotide sequence.

2. An isolated polynucleotide comprising a polynucleotide sequence at least 95% identical to the polynucleotide sequence set forth in SEQ ID NO:6, or the complement of the frill-length polynucleotide sequence, wherein the polynucleotide encodes a polypeptide that elicits an immune response to *Streptococcus* in an individual and that is capable of eliciting an antibody that specifically binds to the polypeptide comprising the amino acid sequence set forth in SEQ ID NO:3.

3. The isolated polynucleotide according to claim 2 comprising a polynucleotide sequence at least 97% identical to the polynucleotide sequence set forth in SEQ ID NO:6, or the complement of the full-length polynucleotide sequence.

4. The polynucleotide according to claim 2 comprising the polynucleotide sequence set forth in SEQ ID NO:6, or the complement of the full-length polynucleotide sequence.

5. The polynucleotide according to any one of claims 1-4 wherein the polynucleotide is DNA.

6. The polynucleotide according to any one of claims 1-4 wherein the polynucleotide is RNA.

7. A vector comprising the polynucleotide of any one of claims 1-4, wherein the polynucleotide is operably linked to an expression control region.

8. A host cell comprising the vector according to claim 7.

9. A process for producing a polypeptide, said process comprising culturing a host cell according to claim 8 under conditions suitable for expression of the polypeptide.

10. The process according to claim 9, further comprising isolating the expressed polypeptide.

11. The isolated polynucleotide according to claim 2 wherein the *Streptococcus* is *Streptococcus pneumoniae, Streptococcus pyogenes, Streptococcus agalactiae, Streptococcus dysgalactiae*, or *Streptococcus uberis*.

12. The isolated polynucleotide according to claim 2 wherein the *Streptococcus* is *Streptococcus pneumoniae*.

* * * * *